US010961283B2

(12) United States Patent
Kwong et al.

(10) Patent No.: US 10,961,283 B2
(45) Date of Patent: Mar. 30, 2021

(54) SELF-ASSEMBLING INSECT FERRITIN NANOPARTICLES FOR DISPLAY OF CO-ASSEMBLED TRIMERIC ANTIGENS

(71) Applicant: The United States of America, as represented by the Secretary, Department of Health and Human Services, Bethesda, MD (US)

(72) Inventors: Peter Kwong, Washington, DC (US); Ivelin Georgiev, Nashville, TN (US); Michael Gordon Joyce, Washington, DC (US); Masaru Kanekiyo, Chevy Chase, MD (US); Aliaksandr Druz, Germantown, MD (US); Ulrich Baxa, Frederick, MD (US); Joseph Van Galen, North Wales, PA (US); Cheng Cheng, Rockville, MD (US); John Mascola, Rockville, MD (US); Yaroslav Tsybovsky, Frederick, MD (US); Yongping Yang, Potomac, MD (US); Barney Graham, Rockville, MD (US); Syed Mohammad Moin, Bethesda, MD (US); Jeffrey Boyington, Clarksburg, MD (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 0 days.

(21) Appl. No.: 16/312,166

(22) PCT Filed: Jun. 27, 2017

(86) PCT No.: PCT/US2017/039595
§ 371 (c)(1),
(2) Date: Dec. 20, 2018

(87) PCT Pub. No.: WO2018/005558
PCT Pub. Date: Jan. 4, 2018

(65) Prior Publication Data
US 2019/0330279 A1    Oct. 31, 2019

Related U.S. Application Data

(60) Provisional application No. 62/355,212, filed on Jun. 27, 2016.

(51) Int. Cl.
*C07K 14/11* (2006.01)
*A61K 39/21* (2006.01)
*C12N 7/00* (2006.01)
*C07K 14/08* (2006.01)
*C07K 14/16* (2006.01)
*C07K 14/165* (2006.01)
*C07K 14/435* (2006.01)
*A61K 39/00* (2006.01)

(52) U.S. Cl.
CPC .............. *C07K 14/11* (2013.01); *A61K 39/21* (2013.01); *C07K 14/082* (2013.01); *C07K 14/162* (2013.01); *C07K 14/165* (2013.01); *C07K 14/43563* (2013.01); *C12N 7/00* (2013.01); *A61K 2039/55555* (2013.01); *C07K 2319/735* (2013.01); *C12N 2740/16134* (2013.01); *C12N 2760/16134* (2013.01); *C12N 2770/20034* (2013.01)

(58) Field of Classification Search
None
See application file for complete search history.

(56) References Cited

U.S. PATENT DOCUMENTS

2004/0006001 A1    1/2004  Carter et al.
2014/0072958 A1*   3/2014  Nabel .................. A61K 39/145
                                                              435/5
2014/0302079 A1   10/2014  Nabel et al.

FOREIGN PATENT DOCUMENTS

| WO | WO 2013/044203 | 3/2013 |
| WO | WO 2015/048149 | 4/2015 |
| WO | WO 2015/183969 | 12/2015 |
| WO | WO 2016/037154 | 3/2016 |

OTHER PUBLICATIONS

Hamburger et al., Crystal Structure of a Secreted Insect Ferritin Reveals a Symmetrical Arrangement of Heavy and Light Chains, 2005, JMB, vol. 349, pp. 558-569.*
Hamburger, et al. "Crystal structure of a secreted insect ferritin reveals a symmetrical arrangement of heavy and light chains." *Journal of Molecular Biology* 349, No. 3 (2005): 558-569.
Kanekiyo, et al. "Self-assembling influenza nanoparticle vaccines elicit broadly neutralizing H1N1 antibodies." *Nature* 499, No. 7456 (2013): 102.
Sliepen, et al. "Presenting native-like HIV-I envelope trimers on ferritin nanoparticles improves their immunogenicity." *Retrovirology* 12, No. 1 (2015): 82.

* cited by examiner

*Primary Examiner* — Benjamin P Blumel
(74) *Attorney, Agent, or Firm* — Klarquist Sparkman, LLP

(57) ABSTRACT

Disclosed are recombinant insect ferritin nanoparticles that can be used to display two different trimeric antigens at an equal ratio. Also disclosed are nucleic acids encoding the recombinant insect ferritin nanoparticles and methods of producing the recombinant insect ferritin nanoparticles. Methods for eliciting an immune response in a subject are also provided.

34 Claims, 22 Drawing Sheets
Specification includes a Sequence Listing.

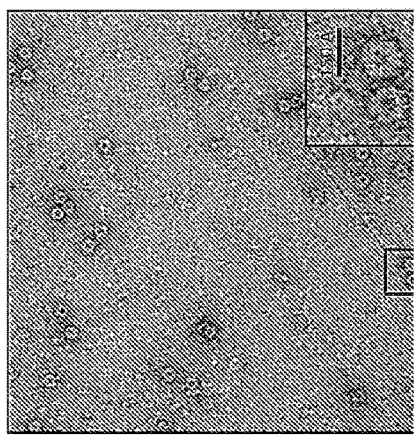
FIG. 1C
iFerr with no antigens attached
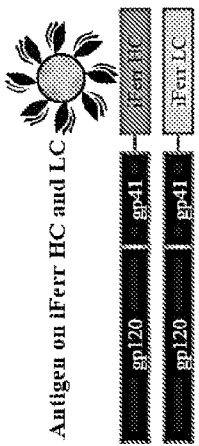
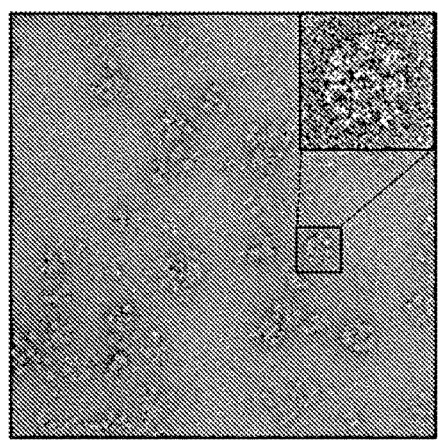
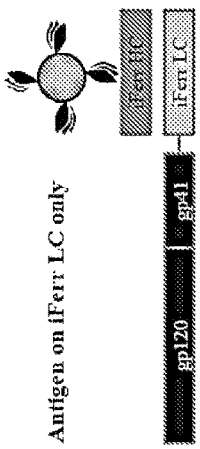
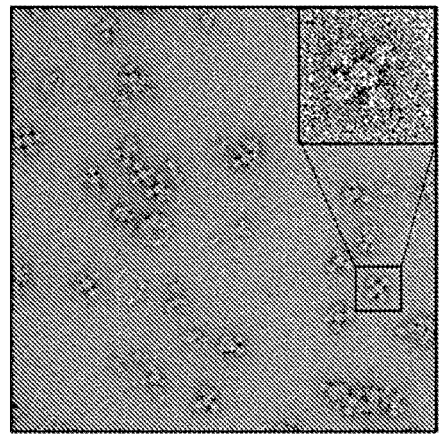
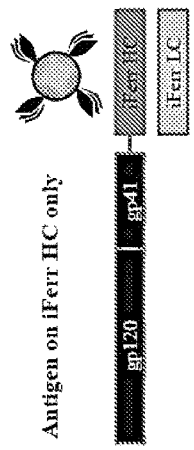
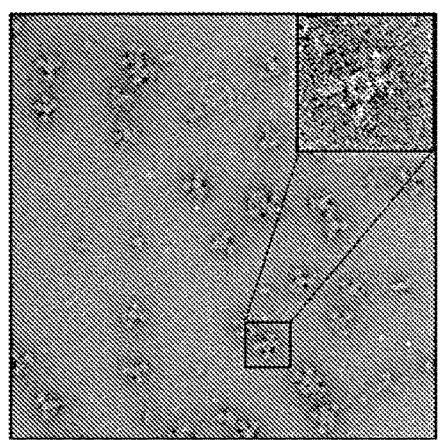
FIG. 1D

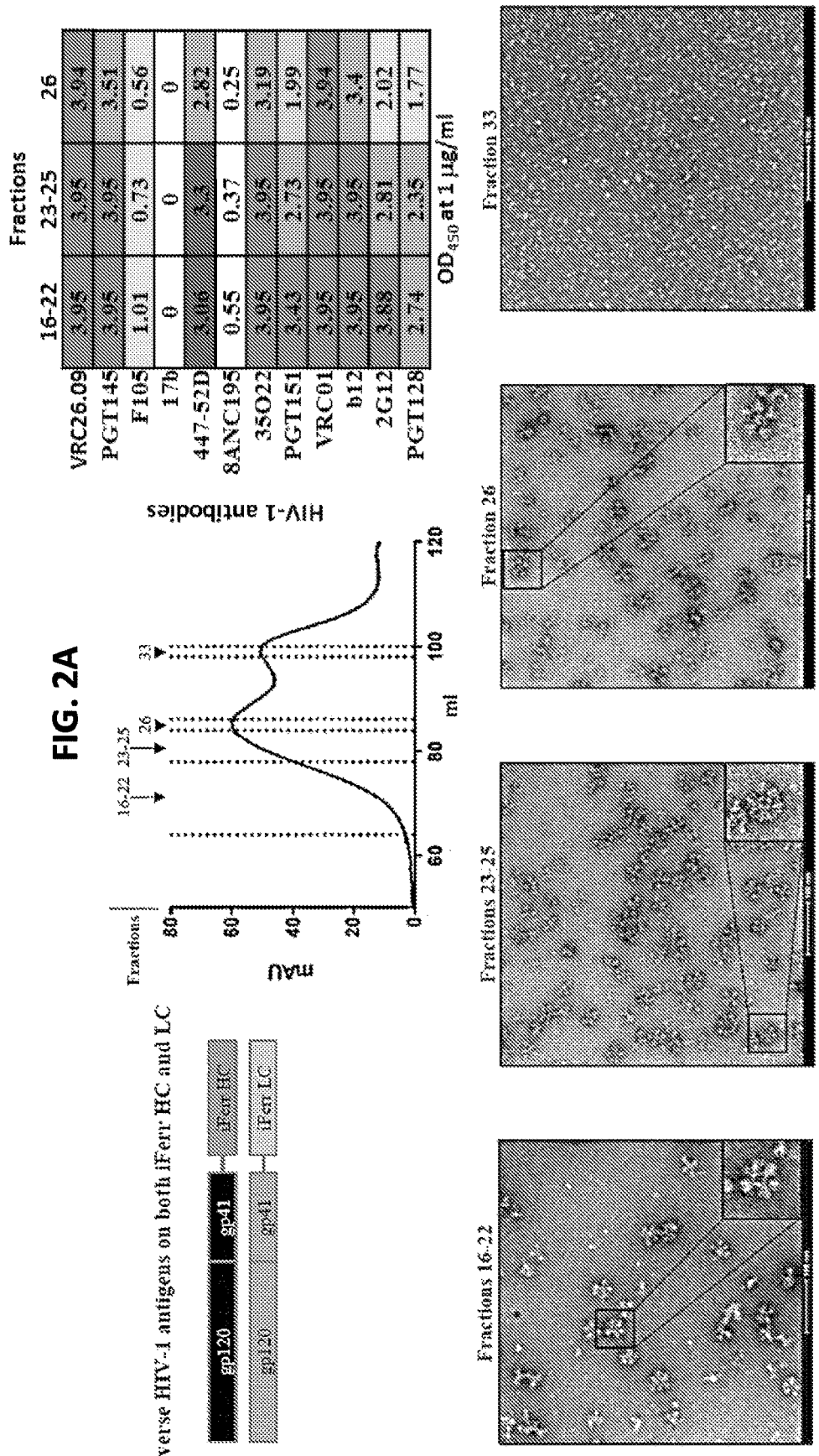

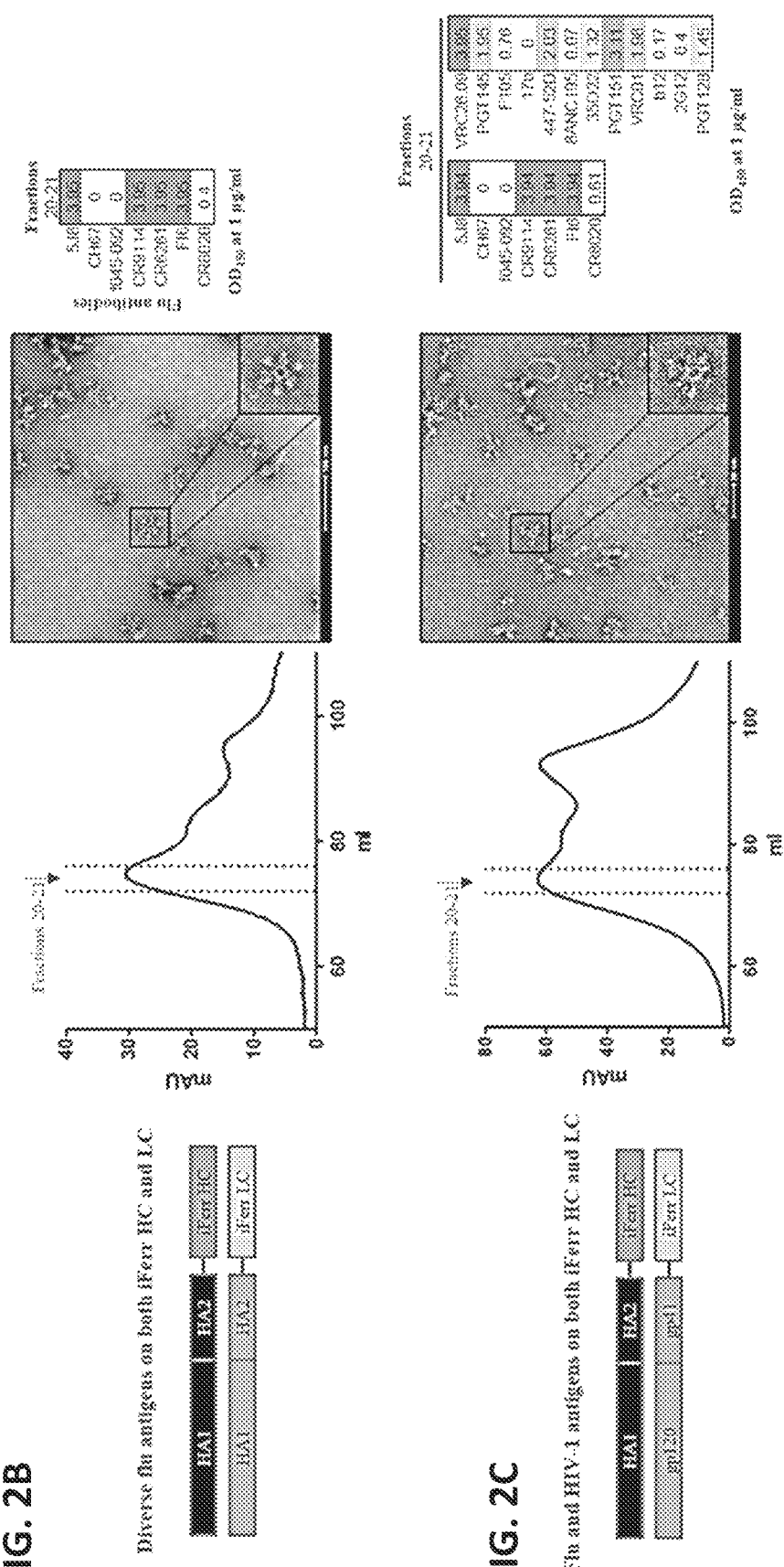

FIG. 5B
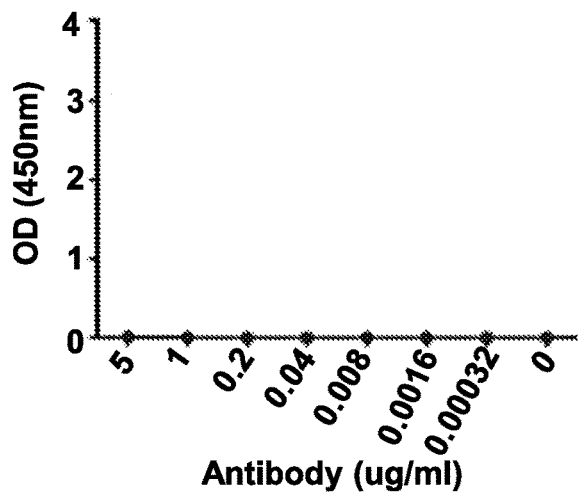
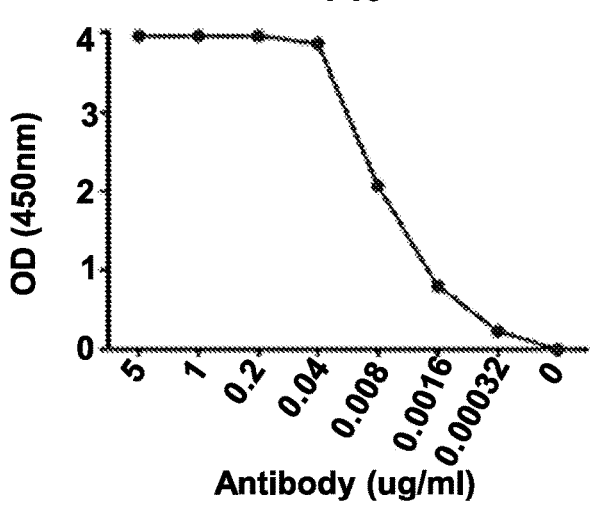
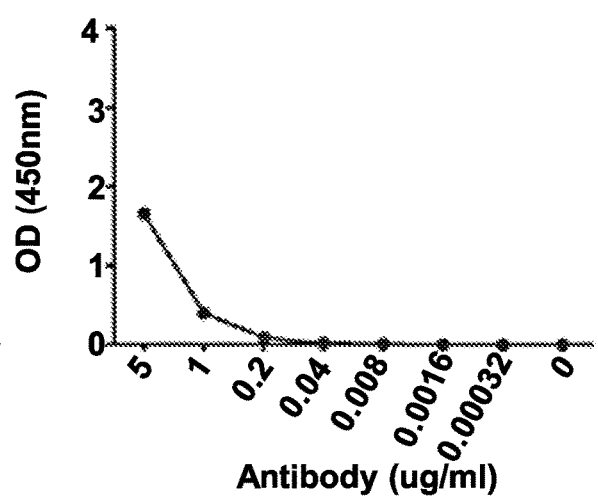
★ Fraction 20-21

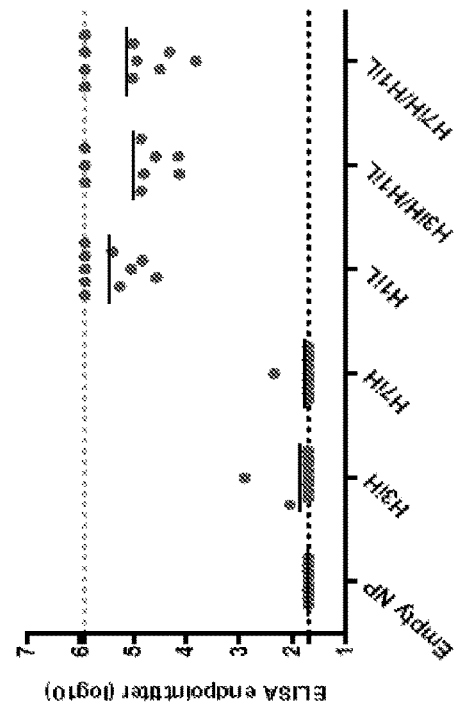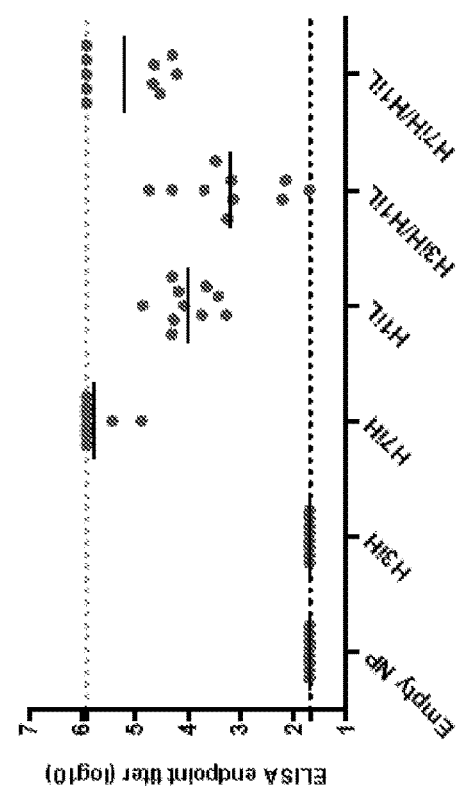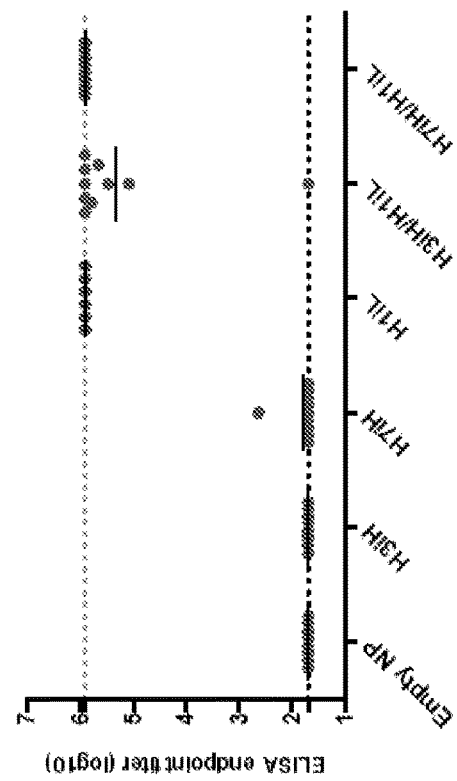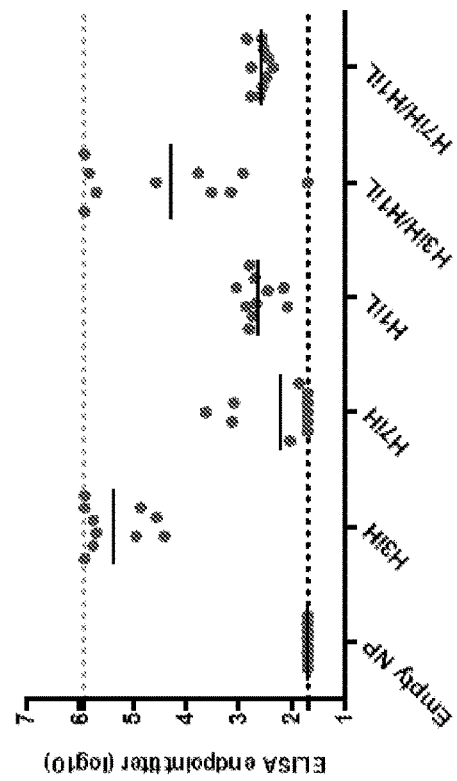
FIG. 15 Immunogenicity of HA stem iFerritin nanoparticles

SELF-ASSEMBLING INSECT FERRITIN NANOPARTICLES FOR DISPLAY OF CO-ASSEMBLED TRIMERIC ANTIGENS

CROSS REFERENCE TO RELATED APPLICATIONS

This is the U.S. National Stage of International Application No. PCT/US2017/039595, filed Jun. 27, 2017, which was published in English under PCT Article 21(2), which in turn claims the benefit of U.S. Provisional Application No. 62/355,212, filed Jun. 27, 2016. The provisional application is incorporated by reference herein in its entirety.

FIELD

This disclosure relates to polypeptides, polynucleotides, compositions, and methods of their use, for elicitation and detection of an immune response to trimeric antigens.

BACKGROUND

The presentation of viral antigens in a regular repetitive pattern on the surface of virus particles facilitates B-cell activation. Presentation of trimeric antigens on engineered particles that mimic the geometric patterns observed for native viral proteins can lead to an improved host antibody response. Self-assembling globular ferritin nanoparticles have previously been used to display multiple copies of a co-assembled trimeric antigen to the immune system. However, prior ferritin nanoparticle technologies only permit the random co-assembly of diverse trimeric antigens, and therefore cannot guarantee the pattern and ratio of diverse trimeric antigens on a single ferritin nanoparticle.

SUMMARY

This disclosure provides novel recombinant ferritin nanoparticles that are based on insect ferritin proteins, and that have been engineered for display of two different trimeric antigens at an equal ratio. Unlike bacterial ferritin, insect ferritin includes twelve copies of two different subunits (termed heavy and light chains; 24 subunits total). The insect ferritin heavy chains trimerize and the insect ferritin light chains trimerize (forming four trimers of heavy chains and four trimers of light chains) and self-assemble into a globular nanoparticle. In several embodiments of the recombinant insect ferritin nanoparticles, the insect ferritin heavy chains are fused to a first protein antigen, and the insect ferritin light chains are fused to a second protein antigen. When the insect ferritin heavy and light chains assemble into the globular nanoparticle, the first protein antigens and the second protein antigens co-assemble into first antigen trimers and second antigen trimers, respectfully. Display of the two diverse antigens on the same ferritin nanoparticle allows B cells to simultaneously recognize both trimeric antigens, thus leading to an immune response with improved neutralization breadth.

In some embodiments, the recombinant insect ferritin nanoparticle comprises twelve recombinant insect ferritin heavy chain fusion proteins and twelve recombinant insect ferritin light chain fusion proteins self-assembled into a globular nanoparticle, and eight self-assembled heterologous trimeric antigens extending radially outward from the outer surface of the globular nanoparticle such that the recombinant insect ferritin nanoparticle comprises a shape having an tetrahedral symmetry. The eight heterologous trimeric antigens comprise four trimers of a first protein and four trimers of a second protein having a different amino acid sequence from the first protein. The recombinant insect ferritin heavy chain fusion proteins comprise an N-terminal fusion of the first protein to a recombinant insect ferritin heavy chain, and the recombinant insect ferritin light chain fusion proteins comprise an N-terminal fusion of the second protein to a recombinant insect ferritin light chain.

In some embodiments, the insect ferritin heavy and light chain of the recombinant insect ferritin nanoparticle are *Trichoplusia ni* ferritin heavy and light chains, respectively. For example, in some embodiments, the insect ferritin heavy and light chains of the recombinant insect ferritin nanoparticle can comprise amino acid sequences set forth as SEQ ID NOs: 2 and 6, respectively.

In some embodiments, the trimeric antigens included on the recombinant insect ferritin nanoparticle are viral envelope protein ectodomain trimers and the first protein and the second protein comprise a first viral envelope protein ectodomain and a second viral envelope protein ectodomain, respectively. For example, the first and second viral envelope protein ectodomains can be viral envelope protein ectodomains from two different strains of the same virus, such as two different strains of human immunodeficiency virus type 1 (HIV-1), influenza, respiratory syncytial virus (RSV), or metapneumovirus (MPV). In some embodiments, the first and second viral envelope protein ectodomains comprise HIV-1 Env ectodomains from two different strains of HIV-1, influenza HA ectodomains from two different strains of influenza, RSV F ectodomains from two different strains of RSV, or MPV F ectodomains from two different strains of MPV. In some embodiments, the trimeric antigens included on the recombinant insect ferritin nanoparticle are trimers of recombinant influenza HA stem proteins from two different strains of influenza (such as a group 1 strain and a group 2 strain).

In some embodiments, a recombinant insect ferritin nanoparticle is provided that comprises twelve recombinant insect ferritin heavy chains and twelve recombinant insect ferritin light chains self-assembled into a globular ferritin nanoparticle; wherein the recombinant ferritin heavy chains comprise an amino acid sequence at least 90% identical to SEQ ID NO: 2; and the recombinant ferritin light chains comprise an amino acid sequence at least 90% identical to SEQ ID NO: 6. In some such embodiments, the insect ferritin heavy and light chains of the recombinant insect ferritin nanoparticle comprise amino acid sequences set forth as SEQ ID NOs: 2 and 6, respectively.

Nucleic acid molecules encoding the disclosed recombinant insect ferritin heavy chain fusion proteins and/or recombinant insect ferritin light chain fusion proteins are also provided, as are vectors including the nucleic acid molecules, and methods of producing the disclosed recombinant insect ferritin nanoparticles.

Compositions including the recombinant insect ferritin nanoparticles are also provided. The composition can be an immunogenic composition suitable for administration to a subject, and may also be contained in a unit dosage form. The compositions can further include an adjuvant.

Methods of eliciting an immune response in a subject are disclosed, as are methods of treating, inhibiting or inhibiting a viral infection in a subject. The foregoing and other features and advantages of this disclosure will become more apparent from the following detailed description of several embodiments which proceeds with reference to the accompanying figures.

BRIEF DESCRIPTION OF THE FIGURES

FIGS. 1A-1D illustrate recombinant insect ferritin nanoparticles for attachment of two diverse trimeric antigens. (FIG. 1A) Schematic of (upper) single-component ferritin (light blue) with eight copies of trimeric antigen A (black), and (lower) recombinant insect ferritin nanoparticles ("two-component ferritin") with four copies each of trimeric antigens A (black) and B (gray). (FIG. 1B) Design of the (left) recombinant insect ferritin heavy chain (iFerr HC) and (right) recombinant insect ferritin light chain (iFerr LC) in monomer (upper) and particle (lower) form to allow attachment of trimeric antigens. Each of the iFerr HC and iFerr LC included N-terminal truncations to properly position the trimeric antigen on the self-assembled globular insect ferritin nanoparticle. (FIG. 1C) Negative-stain EM of designed recombinant insect ferritin particles with no trimeric antigen attached. (FIG. 1D) (upper) Particle schematic and construct design and expression components and (Lower) negative-stain EM of recombinant insect ferritin nanoparticles formed with HIV-1 Env gp140 from strain CNE58 attached to iFerr HC only (left), iFerr LC only (middle), and both iFerr HC and LC (right).

FIGS. 2A-2C illustrate the characterization of recombinant insect ferritin nanoparticles particles with attached antigens from (FIG. 2A) two HIV-1 strains (CNE58 and ZM106.9), (FIG. 2B) two influenza strains (A/California/7/2009 (H1N1) and B/Phuket/3073/2013), and (FIG. 2C) one influenza (A/California/7/2009 (H1N1)) and one HIV-1 strain (CNE58). For each recombinant insect ferritin nanoparticle, a schematic representation of the respective construct, a size-exclusion chromatography profile with highlighted fractions, and corresponding negative-stain EM, with close-ups of selected particle structures, and antigenicity data for a set of HIV-1 and/or influenza antibodies (represented as a heat map for OD450 values at 1 µg/ml antibody concentration) is shown.

FIGS. 5A and 5B show a set of graphs of results of antigenic characterization of recombinant insect ferritin nanoparticles including influenza HA ectodomains from strain A/California/7/2009 (H1N1) HA on iFerr HC and strain B/Phuket/3073/2013 (B/Yamagata lineage) HA on iFerr LC by lectin-capture ELISA following size-exclusion chromatography. The recombinant insect ferritin nanoparticles were assessed against a panel of both HA head-specific (5J8, CH67 and f045-092) and HA stem-specific (CR9114, CR6261, FI6 and CR8020) antibodies.

FIG. 15 shows a set of graphs of results for the immunogenicity of two-component insect ferritin nanoparticles including recombinant influenza HA stem proteins as antigens. Immune sera was collected from mice immunized with the indicated nanoparticle and evaluated for binding to various influenza strains by endpoint ELISA binding assay.

SEQUENCES

Figure 1B:
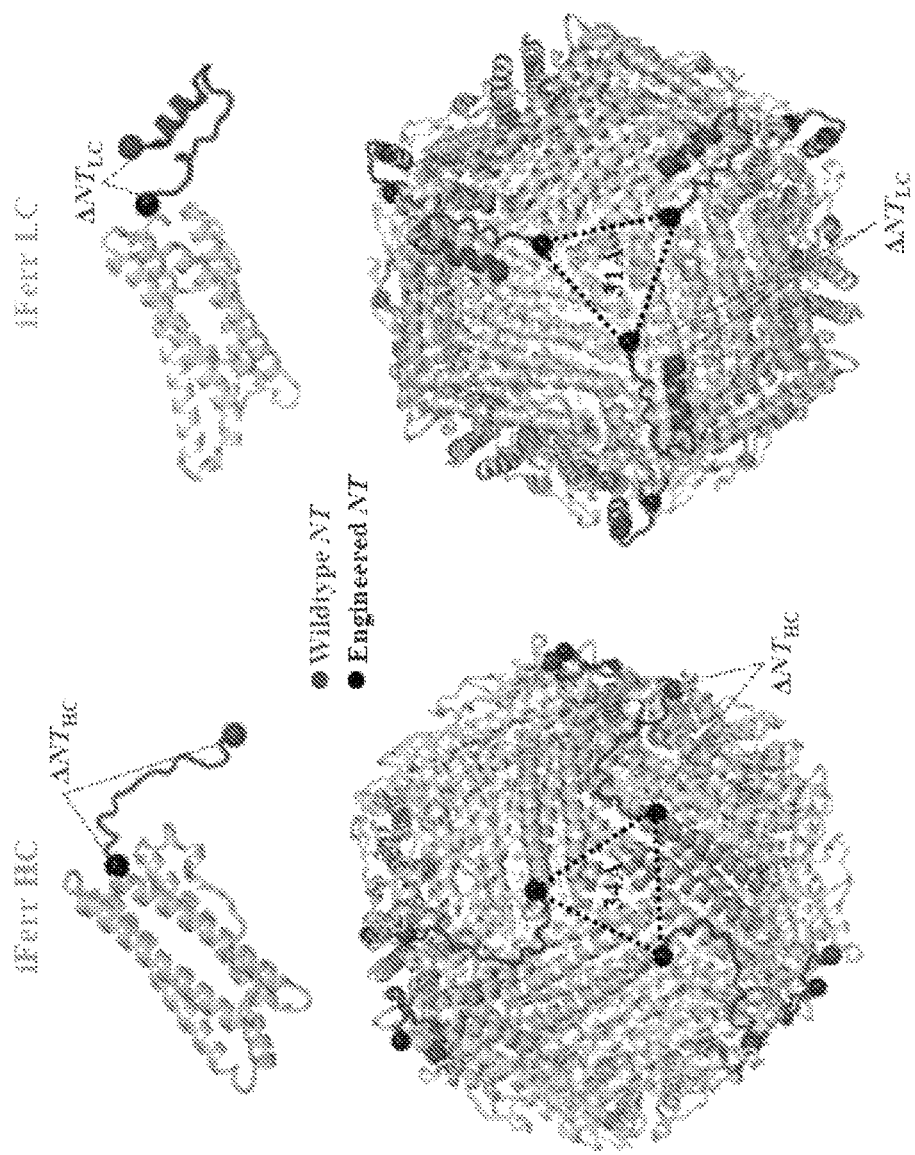

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~1 Mb), which was created on Nov. 28, 2018, which is incorporated by reference herein. In the accompanying sequence listing:

SEQ ID NO: 1 is the amino acid sequence of *Trichoplusia ni* ferritin heavy chain.

SEQ ID NO: 2 is the amino acid sequence of *Trichoplusia ni* ferritin heavy chain with 18-aa N-terminal truncation (nt19).

SEQ ID NO: 3 is the amino acid sequence of manduca ferritin heavy chain.

SEQ ID NO: 4 is the amino acid sequence of manduca ferritin heavy chain with 38-aa truncation (nt39).

SEQ ID NO: 5 is the amino acid sequence of *Trichoplusia ni* ferritin light chain.

SEQ ID NO: 6 is the amino acid sequence of *Trichoplusia ni* ferritin light chain with an 29-aa N-terminal truncation (nt30).

SEQ ID NO: 7 is the amino acid sequence of manduca ferritin light chain.

SEQ ID NO: 8 is the amino acid sequence of manduca ferritin light chain with a 48-aa N-terminal truncation (nt49).

SEQ ID NOs: 9-25 are amino acid sequences of HIV-1 Env proteins.

SEQ ID NOs: 26-84 are amino acid sequences of fusion proteins including an insect ferritin heavy or light chain fused to an HIV-1 Env ectodomain.

SEQ ID NOs: 85-128 are amino acid sequences of influenza HA proteins.

SEQ ID NOs: 129-140 are amino acid sequences of fusion proteins including an insect ferritin heavy or light chain fused to an influenza HA ectodomain.

SEQ ID NOs: 141-148 are amino acid sequences of RSV F proteins.

SEQ ID NOs: 149-156 are amino acid sequences of fusion proteins including an insect ferritin heavy or light chain fused to an RSV F ectodomain.

SEQ ID NOs: 157-163 are amino acid sequences of MPV F proteins.

SEQ ID NOs: 164 and 165 are signal peptide sequences.

SEQ ID NOs: 166-183 are amino acid sequences of fusion proteins including an insect ferritin heavy or light chain fused to a recombinant influenza HA stem.

SEQ ID NOs: 184-186 are signal peptide sequences.

DETAILED DESCRIPTION

An effective vaccine against various viruses, such as HIV-1, influenza, and RSV, among others, likely requires an immunogen that elicits broad and potent neutralizing antibodies against antigens of the respective virus. Kanekiyo et al. (Nature, 499:102-106, 2013, incorporated by reference herein in its entirety) recently engineered a self-assembling recombinant bacterial ferritin nanoparticle that can display eight influenza HA ectodomain trimers on its surface. These bacterial ferritin nanoparticles include 24 copies of the same ferritin subunit, each with an N-terminal fusion to the influenza HA ectodomain. The influenza HA ectodomains co-assemble into trimers as the ferritin subunits self-assemble into the globular nanoparticle structure. Using these recombinant bacterial ferritin nanoparticles, a substantially improved neutralizing antibody response was achieved compared to a control influenza HA trimer not displayed on a nanoparticle. Although these prior ferritin nanoparticles (based on bacterial ferritin protein) can successfully display one type of trimeric antigen, they cannot be used to display two different trimeric antigens at an equal ratio, a feature that can contribute to the effectiveness of an immunogen to elicit broadly neutralizing antibodies against viral antigens.

This disclosure provides novel recombinant ferritin nanoparticles that are based on insect ferritin proteins that have been engineered for display of two different trimeric antigens at an equal ratio. Unlike bacterial ferritin, insect ferritin includes twelve copies of two different subunits (termed heavy and light chains; 24 subunits total) that self-assemble into the globular ferritin nanoparticle. The insect ferritin heavy chains trimerize and the insect ferritin light chains trimerize (forming four trimers of heavy chains and four trimers of light chains) and self-assemble into the globular insect ferritin nanoparticle. In the disclosed recombinant insect ferritin nanoparticles, the insect ferritin heavy chain subunits are fused to a first antigen, and the insect ferritin light chain subunits are fused to a second antigen. When the insect ferritin heavy and light chain subunits assemble into the globular ferritin nanoparticle structure, the first antigens and the second antigens co-assemble into first antigen trimers and second antigen trimers. Display of the two diverse antigen trimers on the same ferritin nanoparticle allows B cells to simultaneously recognize both antigen trimers, thus leading to improved breadth of recognition.

I. Summary of Terms

Unless otherwise noted, technical terms are used according to conventional usage. Definitions of common terms in molecular biology may be found in Benjamin Lewin, *Genes X*, published by Jones & Bartlett Publishers, 2009; and Meyers et al. (eds.), *The Encyclopedia of Cell Biology and Molecular Medicine*, published by Wiley-VCH in 16 volumes, 2008; and other similar references. As used herein, the singular forms "a," "an," and "the," refer to both the singular as well as plural, unless the context indicates otherwise. For example, the term "an antigen" includes single or plural antigens and can be considered equivalent to the phrase "at least one antigen." As used herein, the term "comprises" means "includes." Thus, "comprising an antigen" means "including an antigen" without excluding other elements. It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described below. In case of conflict, the present specification, including explanations of terms, will control. In addition, the materials, methods, and examples are illustrative only and not intended to be limiting. To facilitate review of the various embodiments, the following explanations of terms are provided:

17b: A monoclonal antibody that specifically binds to a CD4-induced epitope on the HIV-1 Env ectodomain trimer, that is, CD4 binding causes a conformation change in the HIV-1 Env ectodomain trimer that exposes the 17b epitope. Thus, 17b mAb is a "CD4-induced" antibody. The 17b antibody does not specifically bind to the HIV-1 Env ectodomain trimer in its prefusion mature closed conformation. 17b antibody is described, for example, in Kwong et al., J. Biol. Chem., 274, 4115-4123, 1999, which is incorporated by reference herein. The amino acid sequences of the heavy and light variable regions of the 17b antibody been deposited in GenBank as Nos. 1G9N_H (17b $V_H$) and 1G9N_L (17b $V_L$), each of which is incorporated by reference herein as present in the database on Jun. 20, 2014).

447-52D: A monoclonal antibody that specifically binds to the V3 loop of HIV-1 Env. 447-52D antibody and methods of its production are described, for example, in Stanfield et al., Structure, 12, 193-204, which is incorporated by reference herein. The amino acid sequences of the heavy and light variable regions of the 447-52D antibody have been deposited in the Protein Data Bank as Nos. 1Q1J_H (447-52D $V_H$) and 1Q1J_L (447-52D $V_L$), each of which is incorporated by reference herein as present in the database on Jun. 20, 2014).

Adjuvant: A vehicle used to enhance antigenicity. Adjuvants include a suspension of minerals (alum, aluminum hydroxide, or phosphate) on which antigen is adsorbed; or water-in-oil emulsion, for example, in which antigen solution is emulsified in mineral oil (Freund incomplete adjuvant), sometimes with the inclusion of killed mycobacteria (Freund's complete adjuvant) to further enhance antigenicity (inhibits degradation of antigen and/or causes influx of macrophages). Immunostimulatory oligonucleotides (such as those including a CpG motif) can also be used as adjuvants. Adjuvants include biological molecules (a "biological adjuvant"), such as costimulatory molecules. Exemplary adjuvants include IL-2, RANTES, GM-CSF, TNF-α, IFN-γ, G-CSF, LFA-3, CD72, B7-1, B7-2, OX-40L, 4-1BBL, immune stimulating complex (ISCOM) matrix, and toll-like receptor (TLR) agonists, such as TLR-9 agonists, Poly I:C, or PolyICLC. The person of ordinary skill in the art is familiar with adjuvants (see, e.g., Singh (ed.) Vaccine Adjuvants and Delivery Systems. Wiley-Interscience, 2007).

Administration: The introduction of a composition into a subject by a chosen route. Administration can be local or systemic. Exemplary routes of administration include, but are not limited to, oral, injection (such as subcutaneous, intramuscular, intradermal, intraperitoneal, and intravenous), sublingual, rectal, transdermal (for example, topical), intranasal, vaginal, and inhalation routes.

Antibody: An immunoglobulin, antigen-binding fragment, or derivative thereof, that specifically binds and recognizes an analyte (antigen). The term "antibody" is used herein in the broadest sense and encompasses various antibody structures, including but not limited to monoclonal antibodies, polyclonal antibodies, multispecific antibodies (e.g., bispecific antibodies), and antibody fragments, so long as they exhibit the desired antigen-binding activity. Non-limiting examples of antibodies include, for example, intact immunoglobulins and variants and fragments thereof known in the art that retain binding affinity for the antigen. Examples of antibody fragments include but are not limited to Fv, Fab, Fab', Fab'-SH, F(ab')$_2$; diabodies; linear antibodies; single-chain antibody molecules (e.g. scFv); and multispecific antibodies formed from antibody fragments. Antibody fragments include antigen binding fragments either produced by the modification of whole antibodies or those synthesized de novo using recombinant DNA methodologies (see, e.g., Kontermann and Dubel (Ed), Antibody Engineering, Vols. 1-2, $2^{nd}$ Ed., Springer Press, 2010).

Antigen: A compound, composition, or substance that can stimulate the production of antibodies or a T cell response in an animal, including compositions that are injected or absorbed into an animal. An antigen reacts with the products of specific humoral or cellular immunity, including those induced by heterologous antigens, such as the disclosed HIV antigens. Examples of antigens include, but are not limited to, polypeptides, peptides, lipids, polysaccharides, combinations thereof (such as glycopeptides) and nucleic acids containing antigenic determinants, such as those recognized by an immune cell.

Conservative variants: "Conservative" amino acid substitutions are those substitutions that do not substantially affect or decrease a function of a protein, such as the ability of the protein to induce an immune response when administered to a subject. In some embodiments, a disclosed insect ferritin heavy or light chain comprises from 1-10 (such as up to 1, up to 2, up to 3, up to 4, up to 5, up to 6, up to 7, up to 8, up to 9, or up to 10) conservative substitutions compared to a corresponding native insect ferritin heavy or light chain sequence, respectively. The term conservative variation also includes the use of a substituted amino acid in place of an unsubstituted parent amino acid.

Furthermore, one of ordinary skill will recognize that individual substitutions, deletions or additions which alter, add or delete a single amino acid or a small percentage of amino acids (for instance less than 5%, in some embodiments less than 1%) in an encoded sequence are conservative variations where the alterations result in the substitution of an amino acid with a chemically similar amino acid.

Conservative amino acid substitution tables providing functionally similar amino acids are well known to one of ordinary skill in the art. The following six groups are examples of amino acids that are considered to be conservative substitutions for one another:
1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Thus, a conservative substitution does not alter the basic function of a protein of interest. Non-conservative substitutions are those that reduce an activity or function of the protein, such as the ability to induce an immune response when administered to a subject. For instance, if an amino acid residue is essential for a function of the protein, even an otherwise conservative substitution may disrupt that activity.

Control: A reference standard. In some embodiments, the control is a negative control sample obtained from a healthy patient. In other embodiments, the control is a positive control sample obtained from a patient diagnosed with disease or condition. In still other embodiments, the control is a historical control or standard reference value or range of values (such as a previously tested control sample, such as a group of patients with known prognosis or outcome, or group of samples that represent baseline or normal values).

A difference between a test sample and a control can be an increase or conversely a decrease. The difference can be a qualitative difference or a quantitative difference, for example a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 500%, or greater than 500%.

Epitope: An antigenic determinant. These are particular chemical groups or peptide sequences on a molecule that are antigenic, such that they elicit a specific immune response, for example, an epitope is the region of an antigen to which B and/or T cells respond. An antibody can bind to a particular antigenic epitope.

Expression: Transcription or translation of a nucleic acid sequence. For example, a gene is expressed when its DNA is transcribed into an RNA or RNA fragment, which in some examples is processed to become mRNA. A gene may also be expressed when its mRNA is translated into an amino acid sequence, such as a protein or a protein fragment. In a particular example, a heterologous gene is expressed when it is transcribed into an RNA. In another example, a heterologous gene is expressed when its RNA is translated into an amino acid sequence. The term "expression" is used herein to denote either transcription or translation. Regulation of expression can include controls on transcription, translation, RNA transport and processing, degradation of intermediary molecules such as mRNA, or through activation, inactivation, compartmentalization or degradation of specific protein molecules after they are produced.

Expression Control Sequences: Nucleic acid sequences that regulate the expression of a heterologous nucleic acid sequence to which it is operatively linked. Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., *Methods in Enzymology* 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

A polynucleotide can be inserted into an expression vector that contains a promoter sequence which facilitates the efficient transcription of the inserted genetic sequence of the host. The expression vector typically contains an origin of replication, a promoter, as well as specific nucleic acid sequences that allow phenotypic selection of the transformed cells.

Expression vector: A vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

F105: A monoclonal antibody that specifically binds to a conformational epitope on HIV-1 Env that is not present on the prefusion mature closed conformation. The F105 antibody does not specifically bind to HIV-1 Env in its prefusion mature closed conformation. F105 antibody and methods of its production are described, for example, in Posner et al. *J Acquired Immune Defic Syndr* 6:7-14, 1993; which is incorporated by reference herein. The amino acid sequences of the heavy and light variable regions of the F105 antibody have been deposited in the Protein Data Bank (PDB) as No. 1U6A_H (F105 $V_H$) and 1U6A-L (F105 $V_L$), each of which is incorporated by reference herein as present in the database on Jun. 20, 2014).

Ferritin nanoparticle: A multi-subunit, globular shaped protein complex. In nature, native ferritin proteins self-assemble into a globular structure that stores iron and releases it in a controlled fashion. Production and expression of ferritin nanoparticles based on monomeric ferritin subunits that are linked to influenza HA ectodomains have been previously described (see, e.g., Kanekiyo et al., *Nature* 499, 102-106, 2013 and Zhang, Y. *Int. J. Mol. Sci.*, 12:5406-5421, 2011, which are incorporated by reference herein).

Fusion Protein: A single polypeptide chain including the sequence of two or more heterologous proteins, often linked by a peptide linker.

Heterologous: Originating from a different genetic source. A nucleic acid molecule that is heterologous to a cell originated from a genetic source other than the cell in which it is expressed. A heterologous trimeric antigen fused to a recombinant ferritin nanoparticle is an antigen that is not present on the native form of the ferritin nanoparticle.

Host cells: Cells in which a vector can be propagated and its nucleic acid expressed. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Immune response: A response of a cell of the immune system, such as a B cell, T cell, or monocyte, to a stimulus. In one embodiment, the response is specific for a particular antigen (an "antigen-specific response"). In one embodiment, an immune response is a T cell response, such as a CD4+ response or a CD8+ response. In another embodiment, the response is a B cell response, and results in the production of specific antibodies.

Immunogen: A compound, composition, or substance (for example, a recombinant insect ferritin nanoparticles as disclosed herein) that can elicit an immune response in an animal, including compositions that are injected or absorbed into an animal. Administration of an immunogen to a subject can lead to protective immunity against a pathogen of interest.

Immunogenic composition: A composition comprising an immunogen that elicits an immune response, such as a measurable T cell or B cell response (such as production of antibodies) against an antigen included on the immunogen or encoded by a nucleic acid molecule included in the immunogen. In one example, an immunogenic composition is a composition that includes a disclosed recombinant insect ferritin nanoparticle including two different trimeric viral envelope protein ectodomains that induces a measurable CTL response against the viral envelope proteins, or induces a measurable B cell response (such as production of antibodies) against the viral envelope proteins, when administered to a subject. For in vivo use, the immunogenic composition will typically include a recombinant insect ferritin nanoparticles in a pharmaceutically acceptable carrier and may also include other agents, such as an adjuvant.

Isolated: An "isolated" biological component has been substantially separated or purified away from other biological components, such as other biological components in which the component naturally occurs, such as other chromosomal and extrachromosomal DNA, RNA, and proteins. Proteins, peptides, nucleic acids, and viruses that have been "isolated" include those purified by standard purification methods. Isolated does not require absolute purity, and can include protein, peptide, nucleic acid, or virus molecules that are at least 50% pure, such as at least 75%, 80%, 90%, 95%, 98%, 99%, or even 99.9% pure.

Linker: A bi-functional molecule that can be used to link two molecules into one contiguous molecule. Non-limiting examples of peptide linkers include glycine-serine linkers. Unless context indicates otherwise, reference to "linking" or "fusing" a first polypeptide and a second polypeptide (or to two polypeptides "linked" together) refers to covalent linkage of the first polypeptide to the second polypeptide by peptide bond to form a single polypeptide chain, or (if a peptide linker is involved) covalent linkage of the first and second polypeptides to the N and C termini of a peptide linker to form a single polypeptide chain. Thus, reference to a gp120 polypeptide "linked" to a gp41 ectodomain by a peptide linker indicates that the gp120 polypeptide and the gp41 ectodomain are linked to opposite ends of the peptide linker by peptide bonds. Typically, such linkage is accomplished using molecular biology techniques to genetically manipulate DNA encoding the first polypeptide linked to the second polypeptide by the peptide linker.

Native protein, sequence, or disulfide bond: A polypeptide, sequence or disulfide bond that has not been modified, for example by selective mutation. Native protein or native sequence are also referred to as wild-type protein or wild type sequence. A non-native (or "non-natural") disulfide bond is a disulfide bond that is not present in a native protein, for example a disulfide bond that forms in a protein due to introduction of one or more cysteine residues into the protein by genetic engineering.

Nucleic acid molecule: A polymeric form of nucleotides, which may include both sense and anti-sense strands of RNA, cDNA, genomic DNA, and synthetic forms and mixed polymers of the above. A nucleotide refers to a ribonucleotide, deoxynucleotide or a modified form of either type of nucleotide. The term "nucleic acid molecule" as used herein is synonymous with "polynucleotide." A nucleic acid molecule is usually at least 10 bases in length, unless otherwise specified. The term includes single- and double-stranded forms of DNA. A nucleic acid molecule may include either or both naturally occurring and modified nucleotides linked together by naturally occurring and/or non-naturally occurring nucleotide linkages.

Operably linked: A first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked nucleic acid sequences are contiguous and, where necessary to join two protein-coding regions, in the same reading frame.

PGT145: A broadly neutralizing monoclonal antibody that specifically bind to the V1/V2 domain of the HIV-1 Env ectodomain trimer in its prefusion mature closed conformation, and which can inhibit HIV-1 infection of target cells. PGT145 is described, for example, in Walker et al., Nature, 477:466-470, 2011, and Int. Pub. No. WO2012/030904, each of which is incorporated by reference herein). The amino acid sequences of the heavy and light variable regions of PGT145 mAbs have been deposited in GenBank as Nos. JN201910.1 (PGT145 $V_H$), and JN201927.1 (PGT145 $V_L$), each of which is incorporated by reference herein as present in the database on Jun. 20, 2014).

Pharmaceutically acceptable carriers: The pharmaceutically acceptable carriers of use are conventional. *Remington's Pharmaceutical Sciences*, by E. W. Martin, Mack Publishing Co., Easton, Pa., 19th Edition, 1995, describes compositions and formulations suitable for pharmaceutical delivery of the disclosed immunogens.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, immunogenic compositions to be administered can contain minor amounts of non-toxic auxiliary substances, such as wetting or emulsifying agents, preservatives, and pH buffering agents and the like, for example sodium acetate or sorbitan monolaurate. In particular embodiments, suitable for administration to a subject the carrier may be sterile, and/or suspended or otherwise contained in a unit dosage form containing one or more measured doses of the composition suitable to induce the desired immune response. It may also be accompanied by medications for its use for treatment purposes. The unit dosage form may be, for example, in a sealed vial that contains sterile contents or a syringe for injection into a subject, or lyophilized for subsequent solubilization and administration or in a solid or controlled release dosage.

Polypeptide: Any chain of amino acids, regardless of length or post-translational modification (e.g., glycosylation or phosphorylation). "Polypeptide" applies to amino acid polymers including naturally occurring amino acid polymers and non-naturally occurring amino acid polymer as well as in which one or more amino acid residue is a non-natural amino acid, for example an artificial chemical mimetic of a corresponding naturally occurring amino acid. A "residue" refers to an amino acid or amino acid mimetic incorporated in a polypeptide by an amide bond or amide bond mimetic. A polypeptide has an amino terminal (N-terminal) end and a carboxy terminal (C-terminal) end. "Polypeptide" is used interchangeably with peptide or protein, and is used herein to refer to a polymer of amino acid residues. Amino acids in a polypeptide generally are chemically bound together via amide linkages (CONH).

Prime-boost vaccination: An immunotherapy including administration of a first immunogenic composition (the prime) followed by administration of an additional immunogenic composition (the boost) to a subject to induce an immune response. The boost is administered to the subject after the prime; suitable time intervals between administration of the prime and the boost, and examples of such timeframes are known and are disclosed herein. Additional administrations can be included in the prime-boost protocol, for example a second boost.

Recombinant: A recombinant nucleic acid molecule is one that has a sequence that is not naturally occurring, for example, includes one or more nucleic acid substitutions, deletions or insertions, and/or has a sequence that is made by an artificial combination of two otherwise separated segments of sequence. This artificial combination can be accomplished by chemical synthesis or, more commonly, by the artificial manipulation of isolated segments of nucleic acids, for example, by genetic engineering techniques.

A recombinant protein is one that has a sequence that is not naturally occurring or has a sequence that is made by an artificial combination of two otherwise separated segments of sequence. In several embodiments, a recombinant protein is encoded by a heterologous (for example, recombinant) nucleic acid that has been introduced into a host cell, such as a bacterial or eukaryotic cell, or into the genome of a recombinant virus.

Sequence identity: The similarity between amino acid or nucleic acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs or variants of a polypeptide or nucleic acid molecule will possess a relatively high degree of sequence identity when aligned using standard methods.

Methods of alignment of sequences for comparison are well known in the art. Various programs and alignment algorithms are described in: Smith and Waterman, *Adv. Appl. Math.* 2:482, 1981; Needleman and Wunsch, *J. Mol. Biol.* 48:443, 1970; Pearson and Lipman, *Proc. Natl. Acad. Sci. U.S.A.* 85:2444, 1988; Higgins and Sharp, *Gene* 73:237, 1988; Higgins and Sharp, *CABIOS* 5:151, 1989; Corpet et al., *Nucleic Acids Research* 16:10881, 1988; and Pearson and Lipman, *Proc. Natl. Acad. Sci. U.S.A.* 85:2444, 1988. Altschul et al., *Nature Genet.* 6:119, 1994, presents a detailed consideration of sequence alignment methods and homology calculations.

The NCBI Basic Local Alignment Search Tool (BLAST) (Altschul et al., *J. Mol. Biol.* 215:403, 1990) is available from several sources, including the National Center for Biotechnology Information (NCBI, Bethesda, Md.) and on the internet, for use in connection with the sequence analysis programs blastp, blastn, blastx, tblastn and tblastx. A description of how to determine sequence identity using this program is available on the NCBI website on the internet.

Homologs and variants of a polypeptide (such as an insect ferritin heavy or light chain) are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

As used herein, reference to "at least 90% identity" refers to "at least 90%, at least 91%, at least 92%, at least 93%, at least 94%, at least 95%, at least 96%, at least 97%, at least 98%, at least 99%, or even 100% identity" to a specified reference sequence.

Signal Peptide: A short amino acid sequence (e.g., approximately 18-25 amino acids in length) that directs newly synthesized secretory or membrane proteins to and through membranes (for example, the endoplasmic reticulum membrane). Signal peptides are typically located at the N-terminus of a polypeptide and are removed by signal peptidases after the polypeptide has crossed the membrane. Signal peptide sequences typically contain three common structural features: an N-terminal polar basic region (n-region), a hydrophobic core, and a hydrophilic c-region).

Specifically bind: When referring to the formation of an antibody:antigen protein complex, refers to a binding reaction that determines the presence of a target protein, peptide, or polysaccharide (for example a glycoprotein), in the presence of a heterogeneous population of proteins and other biologics. Thus, under designated conditions, an antibody binds preferentially to a particular target protein, peptide or polysaccharide and does not bind in a significant amount to other proteins or polysaccharides present in the sample or subject. Specific binding can be determined by methods known in the art. With reference to an antibody:antigen complex, specific binding of the antigen and antibody has a $K_d$ (or apparent $K_a$) of less than about $10^{-6}$ Molar, such as less than about $10^{-7}$ Molar, $10^{-8}$ Molar, $10^{-9}$, or even less than about $10^{-10}$ Molar.

Subject: Living multi-cellular vertebrate organisms, a category that includes human and non-human mammals. In an example, a subject is a human. In a particular example, the subject is a newborn infant. In an additional example, a subject is selected that is in need of inhibiting of an HIV or influenza infection.

Treating or inhibiting a disease: Inhibiting the full development of a disease or condition, for example, in a subject who is at risk for a disease such as HIV-1 infection or acquired immunodeficiency syndrome (AIDS). In another example, treating or inhibiting an influenza infection refers to decreasing symptoms resulting from infection by the virus, such as preventing the development of symptoms in a person who is known to have been exposed to the virus or to lessening virus number or infectivity of a virus in a subject exposed to the virus. "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, a reduction in the number of relapses of the disease, an improvement in the overall health or well-being of the subject, or by other parameters well known in the art that are specific to the particular disease.

An immunogenic composition that can induce an immune response that inhibits or treats an infection, can, but does not necessarily completely, eliminate or prevents such an infection, so long as the infection is measurably diminished, for example, by at least about 50%, such as by at least about 70%, or about 80%, or even by about 90% of (that is to 10% or less than) of the infection in the absence of the agent, or in comparison to a reference agent.

Vaccine: A preparation of immunogenic material capable of stimulating an immune response, administered for the prevention, amelioration, or treatment of infectious or other types of disease. In several embodiments, the immunogenic material may include a recombinant insect ferritin nanoparticle displaying two different viral envelope protein ectodomain trimers, as discussed herein. Vaccines may elicit both prophylactic (preventative or protective) and therapeutic responses. Methods of administration vary according to the vaccine, but may include inoculation, ingestion, inhalation or other forms of administration. Vaccines may be administered with an adjuvant to boost the immune response. In one specific, non-limiting example, a vaccine prevents and/ or reduces the severity of the symptoms associated with influenza or HIV-1 infection compared to a control.

VRC01: A neutralizing monoclonal antibody that specifically binds to the CD4 binding site on HIV-1 Env and can inhibit HIV-1 infection of target cells. VRC01 antibody and its production are described, for example, in Wu et al., Science, 329(5993):856-861, 2010, and PCT publication WO2012/154312, each of which is incorporated by reference herein. The amino acid sequences of the heavy and light variable regions of VRC01 have been deposited in GenBank as Nos. ADF47181.1 (VRC01 $V_H$) and ADF47184.1 (VRC01 $V_L$), each of which is incorporated by reference herein as present in the database on Jun. 20, 2014).

II. Recombinant Insect Ferritin Nanoparticles

This disclosure provides novel recombinant ferritin nanoparticles that are based on insect ferritin proteins, and that have been engineered for display of two different trimeric antigens at an equal ratio. Unlike bacterial ferritin, insect ferritin includes twelve copies of two different subunits (termed heavy and light chains; 24 subunits total). The insect ferritin heavy chains trimerize and the insect ferritin light chains trimerize (forming four trimers of heavy chains and four trimers of light chains) and self-assemble into the globular nanoparticle. In the disclosed recombinant insect ferritin nanoparticles, each insect ferritin heavy chain includes an N-terminal fusion to a first protein, and each insect ferritin light chain includes an N-terminal fusion to a second protein. As the insect ferritin heavy and light chains trimerize and self-assemble into the globular nanoparticle, the corresponding first and second proteins also self-assemble into trimers of the first protein and trimers of the second protein. Display of two diverse antigen trimers on the same ferritin nanoparticle allows B cells to simultaneously recognize both antigens, thus leading to improved breadth of recognition.

Typically, the recombinant insect ferritin nanoparticle has a tetrahedral symmetry, with the heavy and light chain ferritin proteins forming a globular nanoparticle shape, and the trimers of the first and second proteins extending in a radially outward direction from the outer surface of the globular nanoparticle, giving the entire protein complex a tetrahedral symmetry. In this shape, the trimers of the first and second protein are readily presented to a subject's immune system when the recombinant insect ferritin nanoparticle is administered to the subject. Accordingly, in several embodiments, the recombinant insect ferritin nanoparticles described herein can be used as a platform for multimerized display of trimeric antigens such as viral type I fusion glycoprotein ectodomains, such as the envelope protein ectodomains of HIV-1 and influenza.

In several embodiments, the insect ferritin heavy and light chains can be from the Lepidoptera order of insects, such as ferritin heavy and light chains from *Trichoplusia* (such as *Trichoplusia ni*), or ferritin heavy and light chains from manduca. Exemplary ferritin heavy and light chain amino acid sequences for *Trichoplusia ni* and manduca proteins are provided below:

```
Trichoplusia ni ferritin heavy chain
                (Acc. No., PDB 1Z6O; SEQ ID NO: 1)
TQCNVNPVQIPKDWITMHRSCRNSMRQQIQMEVGASLQYLAMGAHFSKDV

VNRPGFAQLFFDAASEEREHAMKLIEYLLMRGELTNDVSSLLQVRPPTRS

SWKGGVEALEHALSMESDVTKSIRNVIKACEDDSEFNDYHLVDYLTGDFL

EEQYKGQRDLAGKASTLKKLMDRHEALGEFIFDKKLLGIDV

Trichoplusia ni ferritin light chain
                (Acc. No. AAX94729.1; SEQ ID NO: 5)
GITSNSLALPRCNAVYGEYGSHGNVATELQAYAKLHLERSYDYLLSAAYF

NNYQTNRAGFSKLFKKLSDEAWSKTIDIIKHVTKRGDKMNFDQHSTMKTE

RKNYTAENHELEALAKALDTQKELAERAFYIHREATRNSQHLHDPEIAQY

LEEEFIEDHAEKIRTLAGHTSDLKKFITANNGHDLSLALYVFDEYLQKTV

Manduca ferritin heavy chain
                (Acc. No. AAK39636.1; SEQ ID NO: 3)
MKAILLSVAGLLAVLAPAIATQCHVNPVNIQREWITMHRSCRDSMRRQIQ

MEVGASLQYLAMGAHFSKDKINRPGFAKLFFDAAGEEREHAMKLIEYLLM

RGELTNDVTSLIQVRAPQRNKWEGGVDALEHALKMESDVTKSIRTVIKAC

EDDPEFNDYHLVDYLTGEFLEEQYKGQRDLAGKASTLKKMLDRNSALGEF

IFDKKLMGMDI

Manduca ferritin light chain
                (Acc. No. AAF44717.1; SEQ ID NO: 7)
MNPITFFVACLLALCGAVAADTCYQDVSLDCSQVSNSLTLPNCNAVYAEY

GHHGNVAKEMQAYAALHLERSYEYLLSSSYFNNYQTNRAGFSKLFRKLSD

DAWEKTIDLIKHITMRGDEMNFAQRSTQKSVDRKNYTVELHELESLAKAL

DTQKELAERAFFIHREATRNSQHLHDPEVAQYLEEEFIEDHAKTIRNLAG

HTTDLKRFVSGDNGQDLSLALYVFDEYLQKTV
```

As shown in Example 1, analysis of the protein structure of *Trichoplusia ni* ferritin revealed that two different viral strains can be attached in an equal configuration (equal fraction of one strain vs. the other); however, the geometry of the native insect ferritin particle did not allow the attachment of viral envelope protein antigens that assemble as trimers. Accordingly, to properly position the "base" of the trimers formed by the first and second proteins, the insect ferritin heavy and light chains include N-terminal truncations. The truncations position the portion of the first and second proteins that is proximal to the nanoparticle surface in an orientation similar to that found in the native trimer of each of these proteins. For example, in embodiments where the first and second proteins are viral envelope protein ectodomains that co-assemble into trimers on the recombinant insect ferritin nanoparticle, the heavy and light chain N-terminal truncations allow for positioning of the portion of the first and second proteins that is proximal to the nanoparticle surface in an orientation similar to that of the native trimer found on the viral surface.

In some embodiments, the recombinant insect ferritin nanoparticle includes recombinant ferritin heavy chains comprising 172 to 174 amino acids from the C-terminus of an insect ferritin heavy chain and a deletion of the remaining N-terminal amino acids. In additional embodiments, the recombinant insect ferritin nanoparticle comprises recombinant ferritin light chains comprising 182 to 184 amino acids from the C-terminus of an insect ferritin light chain and a deletion of the remaining N-terminal amino acids. In more embodiments, the recombinant insect ferritin nanoparticle comprises recombinant ferritin heavy chains comprising 172 to 174 amino acids from the C-terminus of an insect ferritin heavy chain and a deletion of the remaining N-terminal amino acids, and recombinant ferritin light chains comprise 182 to 184 amino acids from the C-terminus of an insect ferritin light chain and a deletion of the remaining N-terminal amino acids. The N-terminal amino acid of each recombinant heavy and light chain in the recombinant insect ferritin nanoparticle can be fused to the C-terminal amino acid of the first or second protein, respectively (or to a peptide linker that can be fused the C-terminal amino acid of the first or second protein).

In some embodiments, the insect ferritin heavy chain can be a *Trichoplusia ni* ferritin heavy chain with an 18 amino acid N-terminal truncation. For example, the insect ferritin heavy chain comprises an amino acid sequence set forth as SEQ ID NO: 2, or an amino acid sequence at least 90% identical thereto. In some embodiments, the insect ferritin light chain can be a *Trichoplusia ni* ferritin light chain with a 29 amino acid N-terminal truncation. For example, the insect ferritin light chain comprises an amino acid sequence set forth as SEQ ID NO: 6, or an amino acid sequence at least 90% identical thereto. In some embodiments, the insect ferritin heavy chain comprises an amino acid sequence at least 90% identical to SEQ ID NO: 2, and the insect ferritin light chain comprises an amino acid sequence at least 90% identical SEQ ID NO: 6. In some embodiments, the insect ferritin heavy chain comprises an amino acid sequence set forth as SEQ ID NO: 2, and the insect ferritin light chain comprises an amino acid sequence set forth as SEQ ID NO: 6.

In some embodiments, the insect ferritin heavy chain can be a manduca ferritin heavy chain with a 38 amino acid N-terminal truncation. For example, the insect ferritin heavy chain comprises an amino acid sequence set forth as SEQ ID NO: 4, or an amino acid sequence at least 90% identical thereto. In some embodiments, the insect ferritin light chain can be a manduca ferritin light chain with a 48 amino acid N-terminal truncation. For example, the insect ferritin light chain comprises an amino acid sequence set forth as SEQ ID NO: 8, or an amino acid sequence at least 90% identical thereto. In some embodiments, the insect ferritin heavy chain comprises an amino acid sequence at least 90% identical to SEQ ID NO: 4, and the insect ferritin light chain comprises an amino acid sequence at least 90% identical to SEQ ID NO: 8. In some embodiments, the insect ferritin heavy chain comprises an amino acid sequence set forth as SEQ ID NO: 4, and the insect ferritin light chain comprises an amino acid sequence set forth as SEQ ID NO: 8.

Exemplary insect ferritin heavy and light chain sequences with N-terminal truncations are set forth below:

*Trichoplusia* ni ferritin heavy chain with 18-aa N-terminal truncation (nt19)

(SEQ ID NO: 2)

```
RSCRNSMRQQIQMEVGASLQYLAMGAHFSKDVVNRPGFAQLFFDAASEER

EHAMKLIEYLLMRGELTNDVSSLLQVRPPTRSSWKGGVEALEHALSMESD

VTKSIRNVIKACEDDSEFNDYHLVDYLTGDFLEEQYKGQRDLAGKASTLK

KLMDRHEALGEFIFDKKLLGIDV
```

*Trichoplusia* ni ferritin light chain with 29-aa N-terminal truncation (nt30)

(SEQ ID NO: 6)

```
EYGSHGNVATELQAYAKLHLERSYDYLLSAAYFNNYQTNRAGFSKLFKKL

SDEAWSKTIDIIKHVTKRGDKMNFDQHSTMKTERKNYTAENHELEALAKA

LDTQKELAERAFYIHREATRNSQHLHDPEIAQYLEEEFIEDHAEKIRTLA

GHTSDLKKFITANNGHDLSLALYVFDEYLQKTV
```

*Manduca* ferritin heavy chain with 38-aa truncation (nt39)

(SEQ ID NO: 4)

```
RSCRDSMRRQIQMEVGASLQYLAMGAHFSKDKINRPGFAKLFFDAAGEER

EHAMKLIEYLLMRGELTNDVTSLIQVRAPQRNKWEGGVDALEHALKMESD

VTKSIRTVIKACEDDPEFNDYHLVDYLTGEFLEEQYKGQRDLAGKASTLK

KMLDRNSALGEFIFDKKLMGMDI
```

*Manduca* ferritin light chain with 48-aa N-terminal truncation (nt49)

(SEQ ID NO: 8)

```
EYGHHGNVAKEMQAYAALHLERSYEYLLSSSYFNNYQTNRAGFSKLFRKL

SDDAWEKTIDLIKHITMRGDEMNFAQRSTQKSVDRKNYTVELHELESLAK

ALDTQKELAERAFFIHREATRNSQHLHDPEVAQYLEEEFIEDHAKTIRNL

AGHTTDLKRFVSGDNGQDLSLALYVFDEYLQKTV
```

In additional embodiments, the recombinant insect ferritin heavy and light chain proteins can comprise modifications of the ferritin sequences, such as amino acid substitutions, deletions or insertions, glycosylation and/or covalent linkage to unrelated proteins (e.g., a protein tag), as long as the recombinant ferritin protein retains the ability to form a globular ferritin nanoparticle with co-assembled first and second protein trimers. These variations in sequence can be naturally occurring variations or they can be engineered through the use of genetic engineering techniques. In some embodiments, the recombinant insect ferritin heavy chain comprises a L113Y substitution. In some embodiments, the recombinant insect ferritin light chain comprises L123E and 1189K substitutions. In additional embodiments, the recombinant insect ferritin heavy chain comprises a L113Y substitution, and the recombinant insect ferritin light chain comprises L123E and 1189K substitutions.

In certain embodiments, the recombinant insect ferritin nanoparticle provided herein may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the immunogen to be improved or altered, whether the immunogen derivative will be used in a therapy under defined conditions, etc.

The recombinant insect ferritin nanoparticle can be derivatized or linked to another molecule (such as another peptide or protein). In general, the recombinant insect ferritin nanoparticle is derivatized such that the binding of antibodies to the trimeric antigens included on the recombinant insect ferritin nanoparticle is not affected adversely by the derivatization or labeling. For example, the recombinant insect ferritin nanoparticle can be functionally linked (by chemical coupling, genetic fusion, non-covalent association or otherwise) to one or more other molecular entities, such as an antibody or protein or detection tag.

Trimeric Antigens

The heterologous trimeric antigens included on the recombinant ferritin nanoparticle can be trimers of viral proteins, such as recombinant viral envelope protein ectodomain trimers and/or trimers of recombinant influenza HA stem proteins (which are a recombinant form of the influenza HA ectodomain). For example, the first protein can be a viral envelope protein ectodomain that can self-assemble into a trimer, and the second protein can be a viral envelope protein ectodomain that can self-assemble into a trimer. Non-limiting examples of viral envelope protein ectodomain trimers that can be included on the disclosed insect ferritin nanoparticles include trimers of an HIV-1 Env ectodomain, an influenza HA ectodomain, a RSV F ectodomain, an MPV F ectodomain, an HPIV F ectodomain, an Ebola virus GP ectodomain, or a Coronavirus (such as MERS-CoV or SARS-CoV) S protein ectodomain.

In several embodiments, the first and second proteins are envelope protein ectodomains from different strains of the same virus. For example, the first and second proteins can be HIV-1 Env ectodomains, influenza HA ectodomains, RSV F ectodomains, MPV F ectodomains, HPIV F ectodomains from different strains of HIV-1, influenza, RSV, MPV, or HPIV, respectively. In other embodiments, the first and second proteins are envelope protein ectodomains from different viruses. For example, the first and second proteins could be ectodomains from different strains of influenza and RSV, or from influenza and MPV, or from influenza and HPIV, or from RSV and MPV, or from RSV and HPIV, or from MPV and HPIV.

In several embodiments, the recombinant insect ferritin heavy and light chain fusion proteins can be expressed in HEK 293 Freestyle cells. The fusion proteins are secreted from the cells and self-assemble into nanoparticles. The nanoparticles can be purified using known techniques, for example by a few different chromatography procedures, e.g. Mono Q (anion exchange) followed by size exclusion (SUPEROSE® 6) chromatography.

For production purposes, the insect ferritin heavy and light chain fusion proteins can include an N-terminal signal peptide that is cleaved during cellular processing. In some embodiments, the insect ferritin heavy and light chain fusion proteins can include a native signal peptide corresponding to a viral envelope protein ectodomain included on the fusion protein. In additional embodiments, the insect ferritin heavy and light chain fusion proteins can include a signal peptide comprising the amino acid sequence set forth as MDSKGSSQKGSRLLLLLVVSNLLLPQGVLA (bPRL (LA) signal peptide, SEQ ID NO: 164) or MPMGSLQPLATLYLLGMLVASVLA (hCD5 signal peptide, SEQ ID NO: 165).

Fusion of the first and second protein to the recombinant insect ferritin heavy and light chains is preferably done such that the first and second proteins do not interfere with self-assembly of the ferritin heavy and light chains into the globular insect ferritin nanoparticle structure, and that the ferritin heavy and light chains do not interfere with the trimerization of the first proteins or the trimerization of the second proteins. In some embodiments, the insect ferritin heavy and light chains can be fused directly to the first and second proteins, respectively, without affecting ferritin self-assembly or antigen trimerization. In other embodiments, the insect ferritin heavy and light chains can be fused indirectly to the first and second proteins, respectively, using a peptide linker. The peptide linker can position the ferritin heavy and light chains and the first and second protein, respectively, with regard to one another, such that the fusion protein maintains the ability to self-assemble into nanoparticles including trimerized first and second proteins. Preferable amino acids for the peptide linker include those having small side chains and/or those which are not charged. Such amino acids are less likely to interfere with proper folding and activity of the fusion protein. Accordingly, preferred amino acids to use in linker sequences, either alone or in combination are serine, glycine and alanine (such as a glycine linker, a serine linker, or a glycine-serine linker). Non-limiting exemplary linker sequences include SGG, GGSGG (residues 651-655 of SEQ ID NO: 26), and AGGSGG (residues 213-218 of SEQ ID NO: 171).

The following provides a discussion of exemplary HIV-1 Env ectodomains, influenza HA ectodomains, RSV F ectodomains, and MPV F ectodomains that can be included on the disclosed recombinant insect ferritin nanoparticles.

1. HIV-1 Env Ectodomains

In some embodiments, the insect ferritin heavy chain fusion proteins and/or insect ferritin light chain fusion proteins of the recombinant insect ferritin nanoparticle can comprise first or second proteins that are HIV-1 Env ectodomains, to produce a recombinant insect ferritin nanoparticle with two different trimeric HIV-1 Env ectodomains on its surface.

HIV-1 Env is initially synthesized as a precursor protein of 845-870 amino acids in size, designated gp160. In cells, individual gp160 polypeptides form a homotrimer and undergo glycosylation within the Golgi apparatus as well as processing to remove the signal peptide, and cleavage by a cellular protease between approximately positions 511/512 to generate separate gp120 and gp41 polypeptide chains, which remain associated as gp120-gp41 protomers within the homotrimer. The ectodomain (that is, the extracellular portion) of the HIV-1 Env trimer undergoes several structural rearrangements from a prefusion mature (cleaved) closed conformation that evades antibody recognition, through intermediate conformations that bind to receptors CD4 and co-receptor (either CCR5 or CXCR4), to a post-fusion conformation. The HIV-1 Env ectodomain includes the gp120 protein (approximately HIV-1 Env positions 31-511) and the gp41 ectodomain (approximately HIV-1 Env positions 512-644). An HIV-1 Env ectodomain trimer includes a protein complex of three HIV-1 Env ectodomains.

Mature gp120 includes approximately HIV-1 Env residues 31-511, contains most of the external, surface-exposed, domains of the HIV-1 Env trimer, and it is gp120 which binds both to cellular CD4 receptors and to cellular chemokine receptors (such as CCR5). Mature gp41 includes approximately HIV-1 Env residues 512-860, and includes cytosolic-, transmembrane-, and ecto-domains. The gp41 ectodomain (including approximately HIV-1 Env residues 512-644) can interact with gp120 to form an HIV-1 Env protomer that trimerizes to form the HIV-1 Env trimer.

Native gp120 includes five conserved regions (C1-05) and five regions of high variability (V1-V5). Variable region 1 and Variable Region 2 (V1/V2 domain) of gp120 are comprised of ~50-90 residues which contain two of the most variable portions of HIV-1 (the V1 domain and the V2 loop), and one in ten residues of the V1N2 domain are N-glycosylated. Despite the diversity and glycosylation of the V1N2 domain, a number of broadly neutralizing human antibodies have been identified that target this region, including PG9 and PGT122. In some examples the V1/V2 domain includes gp120 positions 126-196. Variable region 3 (V3) of gp120 includes approximately 35-45 amino acids. In some examples the V1/V2 domain includes gp120 positions 296-331.

HIV can be classified into four groups: the "major" group M, the "outlier" group O, group N, and group P. Within group M, there are several genetically distinct clades (or subtypes) of HIV-1. The disclosed recombinant HIV-1 Env proteins can be derived from any type of HIV, such as groups M, N, O, or P, or clade, such as clade A, B, C, D, F, G, H, J, or K, and the like. HIV-1 Env proteins from the different HIV clades, as well as nucleic acid sequences encoding such proteins are known (see, e.g., HIV Sequence Compendium, Division of AIDS, National Institute of Allergy and Infectious Diseases (2013); HIV Sequence Database (hiv-web.lanl.gov/content/hiv-db/mainpage.html).

The HXB2 numbering system has been developed for comparison between different HIV amino acid and nucleic acid sequences. The person of ordinary skill in the art is familiar with the HXB2 numbering system (see, e.g., Korber et al., Human Retroviruses and AIDS 1998: A Compilation and Analysis of Nucleic Acid and Amino Acid Sequences. Korber B, Kuiken C L, Foley B, Hahn B, McCutchan F, Mellors J W, and Sodroski J, Eds. Theoretical Biology and Biophysics Group, Los Alamos National Laboratory, Los Alamos, N. Mex., which is incorporated by reference herein in its entirety). Unless context indicates otherwise, the numbering used in HIV-1 polypeptides disclosed herein is relative to the HXB2 numbering scheme. Exemplary native HIV-1 Env protein sequences are available in the HIV Sequence Database (hiv-web.lanl.gov/content/hiv-db/mainpage.html), and include:

```
HXB2 (Clade B)
                                              (SEQ ID NO: 9)
MRVKEKYQHLWRWGWRWGTMLLGMLMICSATEKLWVTVYYGVPVWKEATT
TLFCASDAKAYDTEVHNVWATHACVPTDPNPQEVVLVNVTENFNMWKNDM
VEQMHEDIISLWDQSLKPCVKLTPLCVSLKCTDLKNDTNTNSSSGRMIME
KGEIKNCSFNISTSIRGKVQKEYAFFYKLDIIPIDNDTTSYKLTSCNTSV
ITQACPKVSFEPIPIHYCAPAGFAILKCNNKTFNGTGPCTNVSTVQCTHG
IRPVVSTQLLLNGSLAEEEVVIRSVNFTDNAKTIIVQLNTSVEINCTRPN
NNTRKRIRIQRGPGRAFVTIGKIGNMRQAHCNISRAKWNNTLKQIASKLR
EQFGNNKTIIFKQSSGGDPEIVTHSFNCGGEFFYCNSTQLFNSTWFNSTW
STEGSNNTEGSDTITLPCRIKQIINMWQKVGKAMYAPPISGQIRCSSNIT
GLLLTRDGGNSNNESEIFRPGGGDMRDNWRSELYKYKVVKIEPLGVAPTK
AKRRVVQREKRAVGIGALFLGFLGAAGSTMGAASMTLTVQARQLLSGIVQ
QQNNLLRAIEAQQHLLQLTVWGIKQLQARILAVERYLKDQQLLGIWGCSG
KLICTTAVPWNASWSNKSLEQIWNHTTWMEWDREINNYTSLIHSLIEESQ
NQQEKNEQELLELDKWASLWNWFNITNWLWYIKLFIMIVGGLVGLRIVFA
VLSIVNRVRQGYSPLSFQTHLPTPRGPDRPEGIEEEGGERDRDRSIRLVN
GSLALIWDDLRSLCLFSYHRLRDLLLIVTRIVELLGRRGWEALKYWWNLL
QYWSQELKNSAVSLLNATAIAVAEGTDRVIEVVQGACRAIRHIPRRIRQG
LERILL BG505 (Clade A)
                                             (SEQ ID NO: 10)
MRVMGIQRNCQHLFRWGTMILGMIIICSAAENLWVTVYYGVPVWKDAETT
LFCASDAKAYETEKHNVWATHACVPTDPNPQEIHLENVTEEFNMWKNNMV
EQMHTDIISLWDQSLKPCVKLTPLCVTLQCTNVTNNITDDMRGELKNCSF
NMTTELRDKKQKVYSLFYRLDVVQINENQGNRSNNSNKEYRLINCNTSAI
TQACPKVSFEPIPIHYCAPAGFAILKCKDKKFNGTGPCPSVSTVQCTHGI
KPVVSTQLLLNGSLAEEEVMIRSENITNNAKNILVQFNTPVQINCTRPNN
NTRKSIRIGPGQAFYATGDIIGDIRQAHCTVSKATWNETLGKVVKQLRKH
FGNNTIIRFANSSGGDLEVTTHSFNCGGEFFYCNTSGLFNSTWISNTSVQ
GSNSTGSNDSITLPCRIKQIINMWQRIGQAMYAPPIQGVIRCVSNITGLI
LTRDGGSTNSTTETFRPGGGDMRDNWRSELYKYKVVKIEPLGVAPTRAKR
RVVGREKRAVGIGAVFLGFLGAAGSTMGAASMTLTVQARNLLSGIVQQQS
NLLRAIEAQQHLLKLTVWGIKQLQARVLAVERYLRDQQLLGIWGCSGKLI
CTTNVPWNSSWSNRNLSEIWDNMTWLQWDKEISNYTQIIYGLLEESQNQQ
EKNEQDLLALDKWASLWNWFDISNWLWYIKIFIMIVGGLIGLRIVFAVLS
VIHRVRQGYSPLSFQTHTPNPRGLDRPERIEEEDGEQDRGRSTRLVSGFL
ALAWDDLRSLCLFCYHRLRDFILIAARIVELLGHSSLKGLRLGWEGLKYL
WNLLAYWGRELKISAINLFDTIAIAVAEWTDRVIEIGQRLCRAFLHIPRR
IRQGLERALL CAP256.SU (Clade C)
                                             (SEQ ID NO: 11)
MTVTGTWRNYQQWWIWGILGFWMLMICNGLWVTVYYGVPVWREAKTTLFC
ASDAKSYEKEVHNVWATHACVPTDPNPQELVLKNVTENFNMWKNDMVDQM
```

-continued

HEDIISLWDQSLKPCVKLTPLCVTLNCSDAKVNINATYNGTREEIKNCSF
NATTELRDKKKKEYALFYRLDIVPLNKEGNNNSEYRLINCNTSVITQACP
KVTFDPIPIHYCAPAGYAILKCNNKTFNGTGPCNNVSTVQCTHGIKPVVS
TQLLLNGSLAEEEIIIRSENLTDNVKTIIVHLNESVEINCTRPNNNTRKS
IRIGPGQTFYATGDIIGDIRQAHCNISEIKWEKTLQRVSEKLREHFNKTI
IFNQSSGGDLEITTHSFNCGGEFFYCNTSDLFFNKTFDETYSTGSNSTNS
TITLPCRIKQIINMWQEVGRAMYASPIAGEITCKSNITGLLLTRDGGGNN
STEETFRPGGGNMRDNWRSELYKYKVVEVKPLGIAPTEARRRVVQKEKRA
VVGLGAVFLGFLGTAGSTMGAASITLTVQARQLLSGIVQQQSNLLRAIEA
QQHMLQLTVWGIKQLQARVLAIERYLKDQQLLGMWGCSGKLICTTNVYWN
SSWSNKTYNEIWDNMTWMQWDREIDNYTDTIYKLLEVSQKQQESNEKDLL
ALDSWNNLWNWFDISKWLWYIKIFIMIVGGLIGLRIIFAVLSLVNRVRQG
YSPLSFQTLTPNPRELDRLGGIEEEGGEQDRDRSIRLVSGFFSLAWNDLR
SLCLFCYHRLRDFILIAGRAVELLGRSSLQGLQRGWEILKYLGSLVQYWG
LELKKSAINLFDTIAIAVAEGTDRIIEFLQRIVRAILHIPRRIRQGF
EAALQ

BB201.B42 (Clade A)

(SEQ ID NO: 12)

MRVMGIQRNCQHLLTWGIMILGTIIFCSAVENLWVTVYYGVPVWRDADTT
LFCASDAKAYETEKHNVWATHACVPTDPNPQEIHLDNVTEKFNMWKNNMV
EQMHTDIISLWDQSLKPCVKLTPLCVTLECRNITGVNISEGKEEIKNCSF
NITTELRDKRKKVYSLFYRLDVVQIDEGDKNSTQYRLINCNTSAITQACP
KVTFEPIPIHYCAPAGFAILKCNDKEFNGTGPCKNVSTVQCTHGIRPVIS
TQLLLNGSLAEKEVRIRSENITNNAKTIIVQFTESVKINCTRPGNNTRKS
IRIGPGQTFYARGDIIGNIRQAHCNVSRSEWNKTLQQVAKQLGKYFGNKK
VIFNSSSGGDLEITTHSFNCGGEFFYCNTSGLFNSTWTWDNSTWNQVNST
ESNDTIILQCRIKQIINMWQRTGQAIYAPPIQGEIRCVSNITGLLLTRDG
GNNNGTSETFRPEGGNMRDNWRSELYKYKVVEIEPLGVAPTRAKRRVVER
EKRAVGIGAVFLGFLGAAGSTMGATSITLTVQARQLLSGIVQQQNNLLRA
IEAQQHLLKLTVWGIKQLQARVLAVERYLRDQQLLGIWGCSGKLICTTNV
PWNSSWSNKSLDEIWNNMTWLQWDKEINNYTQLIYRLIEESQNQQEKNEK
ELLELDKWANLWSWFDISNWLWYIKIFIIIVGGLIGLRIVFAVLSVINRV
RQGYSPLSFQTHTPNPRGLDRPERIEEEDGEQGRGRSIRLVSGFLALAWD
DLRSLCLFSYHRLRDFILIAARTVELLGHSSLKGLRLGWEGIKYLWNLLS
YWGRELKISAINLVDTIAIAVAGWTDRVIEIAQRIGRAILHIPVRIRQG
LERALL

KER2018.11 (Clade A)

(SEQ ID NO: 13)

MRVMGIQRNCQHLLRRGTMILGMIIICGTAEDLWVTVYYGVPVWKNAETT
LFCASDAKAYKTEVHNVWATHACVPTDPNPQEIHLENVTEEFNVWKNNMV
EQMHTDIISLWDQSLKPCVKLTPLCVTLNCINANVTNSSMTNSSMMEGEI
KNCSYNMTTELRDKKRKVFSLFYKLDVVPMNENNSEYRLINCNTSAITQA

-continued

CPKVTFEPIPIHYCAPAGFAILKCKDEEFNGTGLCKNVSTVQCTHGIKPV
VSTQLLLNGSLAEKEIRIKSENISDNAKTIIVQLTKPVLINCARPSNNTR
KSVHIGPGQAFYATGAITGDIRQAYCVVNRTQWNDTLGQVAIQLRKHWNT
TIIFNEPSGGDLEITTHSFNCGGEFFYCNTSDLFNSTWNIEGTASINGTE
SNDNITLPCRIKQIINMWQRVGQAMYAPPIQGVIRCQSNITGILLTRDGG
NTGNNSRTNETFRPGGGDMRDNWRSELYKYKVVKIEPLGVAPTKAKRRVV
EREKRAVGLGAVFIGFLGAAGSTMGAASITLTVQARQLLSGIVQQQSNLL
RAIEAQQHLLKLTVWGIKQLQARVLAVERYLKDQQLLGIWGCSGKLICTT
NVPWNSSWSNKSYNEIWENMTWLQWDKEINNYTELIYSLIEESQNQQEKN
EQDLLALDKWASLWNWFDISNWLWYIKIFIMIVGGLIGLRIVVAVLSVIN
RVRQGYSPLSFQTHTPNPRGLDRPERIEEEGGEQDRTRSTRLVSGFLALA
WDDLRSLSLFLYHRLRDFILIAARTVELLGHSSLKGLRLGWEGLKYLWNL
LLYWGRELKLSAINLLNTIAIAVAGWTDRVIEIGQGIGRAILHIPRRIRQ
GFERALL

CH070.1 (Clade BC)

(SEQ ID NO: 14)

MRVTGIRKNCRRLWRWGIMLLGMLMICSALENLWVTVYYGVPVWKDATTT
LFCASDAKGYETEVHNVWATHACVPTDPNPQELVLGNVTENFNMWKNDMV
DQMHEDVISLWDQSLKPCVKLTPLCVTLKCKDVSINNGNVSSSNGSTSHN
NSSIDNETLNEGMKEMKNCSFNATTVLRDKKQKVHALFYRLDIVPLNESN
KNSRKYRLINCNTSAITQACPKVTFDPIPIHYCAPAGYAILKCNNKTFNG
TGPCRNVSTVLCTHGIKPVVSTQLLLNGSLAEEDIIIRSENLTNNAKTII
VHLNESVEIVCTRPGNNTRKGIGIGPGQTFYATGEIIGDIRKAHCNISKD
NWTETLYRVSRKLKHFWNKTIIFAPHSGGDLEITTHSFNCRGEFFYCNTS
GLFNGTLNDTYMHNSTKSNETITIPCKIRQIVRMWQQVGQAMYAPPIEGN
ITCKSNITGLLLVRDGGNINRTNETFRPEGGDMRDNWRSELYKYKVVEIK
PLGIAPTKAKRRVVEREKRAVGLGAVFLGFLGIAGSTMGAASITLTVQAR
QLLSGIVQQQNNLLKAIEAQQHLLQLTVWGIKQLQARVLAIERYLKDQQL
LGIWGCSGKLICTTAVAWNSSWSNKSLGEIWDNMTWMQWDKEINNYTSII
YSLLEDSQIQQEKNEKDLLALDSWNNLWNWFDITSWLWYIRLFIMIVGGL
IGLRIIFAVLSIVNRVRQGYSPLSFQTLTPNPIPGGPDRLGRIEEEGGEQ
DRDRSIRLVSGFLALAWDDLRNLCLFSYHRLRDFILVTARVVELLGRSSL
RGLQRGWEALKYLGSLVQYWGQELKKSAISLIDTIAITVAEGTDRIIEAV
QRLCRGIYNIPRRIRQGFEAALQ

ZM233.6 (Clade C)

(SEQ ID NO: 15)

MRVRGIMRNWQQWWIWGSLGFWMLIICNVMGSLWVTVYYGVPVWREAKTT
LFCASDAKAYETEAHSVWATHACVPTDPNPQEMVLENVTENFNMWKNDMV
DQMHEDVISIWDQSLKPCVKLTPLCVTLDCSTYNNTHNISKEMKICSFNM
TTELRDKKRKVNVLFYKLDLVPLTNSSNTTNYRLISCNTSTITQACPKVS
FDPIPIHYCAPAGYAILKCNNKTFNGTGPCNNVSTVQCTHGIKPVVSTQL
LLNGSLAEEEIIIRFENLTDNVKIIIVQLNETINITCTRPNNNTRKSIRI
GPGQSFYATGEIVGNIREAHCNISASKWNKTLERVRTKLKEHFPNKTIEF

```
EPSSGGDLEITTHSFNCGGEFFYCNTSGLFNSAINGTLTSNVTLPCRIKQ
IINMWQEVGRAMYAPPIAGNITCKSNITGLLLTRDGGENSSSTTETFRPT
GGDMKNNWRSELYKYKVVEIKPLGIAPTEAKRRVVEREKRAVGIGAVFLG
FLGAAGSTMGAASMTLTVQARQLLSGIVQQQSNLLKAIEAQQHMLQLTVW
GIKQLQARVLAIERYLKDQQLLGLWGCSGKLICTTNVPWNASWSNKSKND
IWDNMTWMQWDREISNHTDTIYRLLEDSQNQQEKNEKDLLALDSWKNLWN
WFSITKWLWYIKIFIMIVGGLIGLRIIFAVLSIVNRVRQGYSPLSFQTLT
PNPRGPDRLGGIEEEGGEQDKNKSRRLVTGFLPVVWDDLRSLCLFSYHLL
RDFILIVARTVELLGRRGWEALKYLGGLVQYWGLELKKSTISLLDTIAIV
VAEGTDRIIEVLQRIGRAIYNIPRRIRQGFETALL

Q23.17 (Clade A)
                                            (SEQ ID NO: 16)
MRVMGIQRNCQHLLTWGIMILGTIIFCSAVENLWVTVYYGVPVWRDADTT
LFCASDAKAYETEKHNVWATHACVPTDPNPQEIHLDNVTEKFNMWKNNMV
EQMHTDIISLWDQSLKPCVKLTPLCVTLHCTNVTSVNTTGDREGLKNCSF
NMTTELRDKRQKVYSLFYRLDIVPINENQGSEYRLINCNTSAITQACPKV
SFEPIPIHYCTPAGFAILKCKDEFNGTGLCKNVSTVQCTHGIKPVVSTQ
LLLNGSLAEKNITIRSENITNNAKIIIVQLVQPVTIKCIRPNNNTRKSIR
IGPGQAFYATGDIIGDIRQAHCNVTRSRWNKTLQEVAEKLRTYFGNKTII
FANSSGGDLEITTHSFNCGGEFFYCNTSGLFNSTWYVNSTWNDTDSTQES
NDTITLPCRIKQIINMWQRAGQAMYAPPIPGVIKCESNITGLLLTRDGGK
DNNVNETFRPGGGDMRDNWRSELYKYKVVEIEPLGVAPTRAKRRVVEREK
RAVGIGAVFLGFLGAAGSTMGATSITLTVQARQLLSGIVQQQNNLLRAIE
AQQHLLKLTVWGIKQLQARVLAVERYLRDQQLLGIWGCSGKLICTTNVPW
NSSWSNKSLDEIWNNMTWLQWDKEINNYTQLIYRLIEESQNQQEKNEKEL
LELDKWANLSWFDISNWLWYIKIFIIIVGGLIGLRIVFAVLSVINRVRQ
GYSPLSFQTHTPNPRGLDRPERIEEEDGEQGRGRSIRLVSGFLALAWDDL
RSLCLFSYHRLRDFILIAARTVELLGHSSLKGLRLGWEGIKYLWNLLSYW
GRELKISAINLVDTIAIAVAGWTDRVIEIAQRIGRAILHIPVRIRQGLER
ALL A244 (Clade AE)
                                            (SEQ ID NO: 17)
MRVKETQMNWPNLWKWGTLILGLVIICSASDNLWVTVYYGVPVWRDADTT
LFCASDAKAHETEVHNVWATHACVPTDPNPQEIDLENVTENFNMWKNNMV
EQMQEDVISLWDQSLKPCVKLTPLCVTLHCTNANLTKANLTNVNNRTNVS
NIIGNITDEVRNCSFNMTTELRDKKQKVHALFYKLDIVPIEDNNDNSKYR
LINCNTSVIKQACPKISFDPIPIHYCTPAGYAILKCNDKNFNGTGPCKNV
SSVQCTHGIKPVVSTQLLLNGSLAEEEIIIRSEDLTNNAKTIIVHLNKSV
VINCTRPSNNTRTSITIGPGQVFYRTGDIIGDIRKAYCEINGTEWNKALK
QVTEKLKEHFNNKPIIFQPPSGGDLEITMHHFNCRGEFFYCNTTRLFNNT
CIANGTIEGCNGNITLPCKIKQIINMWQGAGQAMYAPPISGTINCVSNIT
GILLTRDGGATNNTNNETFRPGGGNIKDNWRELYKYKVVQIEPLGAAPT RAKRRVVEREKRAVGIGAMIFGFLGAAGSTMGAASITLTVQARQLLSGIV
QQQSNLLRAIEAQQHLLQLTVWGIKQLQARVLAVERYLKDQKFLGLWGCS
GKIICTTAVPWNSTWSNKSLEEIWNNMTWIEWEREISNYTNQIYEILTKS
QDQQDRNEKDLLELDKWASLWTWFDITNWLWYIKIFIMIVGGLIGLRIIF
AVLSIVNRVRQGYSPLSFQTPCHHQREPDRPERIEEEGGEQGRDRSVRLV
SGFLALAWDDLRSLCLFSYHRLRDFILIAARTVELLGRSSLKGLRRGWEG
LKYLGNLLLYWGQELKISAISLLDATAIAVAGWTDRVIEVAQGAWKAILH
IPRRIRQGLERALQ WITO.33 (Clade B)
                                            (SEQ ID NO: 18)
MKVMGTKKNYQHLWRWGIMLLGMLMMSSAAEQLWVTVYYGVPVWREANTT
LFCASDAKAYDTEVHNVWATHACVPTDPNPQEVVMGNVTEDFNMWKNNMV
EQMHEDIISLWDQSLKPCVKLTPLCVTLHCTNVTISSTNGSTANVTMREE
MKNCSFNTTTVIRDKIQKEYALFYKLDIVPIEGKNTNTGYRLINCNTSVI
TQACPKVSFEPIPIHYCAPAGFAILKCNNKTFNGKGPCRNVSTVQCTHGI
KPVVSTQLLLNGSLAEEDIIIRSENFTNNGKNIIVQLKEPVKINCTRPGN
NTRRSINIGPGRAFYATGAIIGDIRKAHCNISTEQWNNTLTQIVDKLREQ
FGNKTIIFNQSSGGDPEVVMHTFNCGGEFFYCNSTQLFNSTWFNNGTSTW
NSTADNITLPCRIKQVINMWQEVGKAMYAPPIRGQIDCSSNITGLILTRD
GGSNSSQNETFRPGGGNMKDNWRSELYKYKVVKIEPLGIAPTRAKRRVVQ
REKRAVTLGAVFLGFLGAAGSTMGAASLTLTVQARLLLSGIVQQQSNLLR
AIEAQQHMLQLTVWGIKQLQARVLAIERYLKDQQLLGIWGCSGKLICTTT
VPWNTSWSNKSYDYIWNNMTWMQWEREIDNYTGFIYTLIEESQNQQEKNE
LELLELDKWASLWNWFNITNWLWYIKLFIMIIGGLVGLRIVCAVLSIVNR
VRQGYSPLSFQTRLPNPRGPDRPEETEGEGGERDRSARLVNGFLAIIW
DDLRSLCLFSYHRLRDLLLIVARVVEILGRRGWEILKYWWNLLKYWSQEL
KNSAVSLLNVTAIAVAEGTDRVIEIVQRAVRAILHIPTRIRQGFERALL ZM53.12 (Clade C)
                                            (SEQ ID NO: 19)
VVGNLWVTVYYGVPVWREAKTTLFCASDAKAYEREVHNVWATHACVPTDP
NPQEMVLENVTENFNMWKNDMVDQMQEDIISLWDQSLKPCVKLTPLCVTL
NCSKLNNATDGEMKNCSFNATTELRDKKKQVYALFYKLDIVPLDGRNNSS
EYRLINCNTSTITQACPKVSFDPIPIHYCAPAGYAILKCNNKTFNGTGPC
HNVSTVQCTHGIKPVISTQLLLNGSTAEEDIIIRSENLTNNAKTIIVHLN
ESIEIECTRPGNNTRKSIRIGPGQAFFATTNIIGDIRQAYCIINKANWTN
TLHRVSKKLEEHFPNKTINFNSSSGGDLEITTHSFNCGGEFFYCNTSSLF
NGTYNDTDIYNSTDIILLCRIKQIINMWQEVGRAMYAPPIEGNITCSSNI
TGLLLTRDGGLTNESKETFRPGGGDMRDNWRSELYKYKVVEIKPLGIAPT
KAKRRVVEREKRAVGLGAMFLGFLGAAGSTMGAASITLTVQARQLSGIV
QQQNNLLRAIEAQQHMLQLTVWGIKQLQARVLAIERYLKDQQLLGLWGCS
GKLVCTTAVPWNSSWSNKSQEDIWNNTTWMQWDKEVSNYTKTIYKLLEKS
QNQQEENEKDLLALDSWNNLWNWFDISNWLWYIKIFIMIVGGLIGLRIIF
AVLSIVNRVRQGYSPLSFQTLTQNPRGLDRLGRIEEEGGEQDRDRSVRLV
```

-continued

NGFLALFWDDLRSLCLFSYHRLRDFILIATRVVELLGRSSLKGLQRGWEA
LRYLGSRVQYWGLELKKSAISLFDTIAIAVAEGTDRIIELIQRSWRAIRN
IPRRIRQGFETALL

CNE58 (Clade C)
(SEQ ID NO: 20)
VGGNMWVTVYYGVPVWKEAKTTLFCASDAKAYETEVHNVWATHACVPTDP
NPQEMVLENVTENFNMWKNEMATQMHEDVISLWDQSLKPCVKLTPLCVTL
DCKNVTLNCGNDTSGNDTLECEKGTNNETYDESVKELRNCSFNATTEVRD
KKQKKYALFYSLDIVPLKNSSEQYRLISCDTSAITQACPKVTFDPIPIHY
CTPAGYAILKCNNKTFNGTGPCNNVSTVQCTHGIKPVVSTQLLLNGSLAE
EEIIVRSENITNNVKTIIVHLNQSVEIVCTRPNNNTRKSIRIGPGQTFYA
TGEIIGDIRQAHCNITKSNWHKTLQEVSKKLAGYFPNKTIIFNSSSGGDL
EITTHSFNCRGEFFYCNTSSLFNSTYMSNGTYMFNDMSNGTERNSSSIIA
IPCRIKQVINMWQEVGRAMYAPPIAGKLTCRSNITGLLLVRDGGTNNATT
ETFRPGGGDMRNNWRSELYKYKVVEIKPLGVAPTEAKRRVVEREKRAVGI
GAVFLGFLGAAGSTMGAASITLTVQARQLLSGIVQQQSNLLRAIEAQQHM
LQLTVWGIKQLQTRVLAIERYLKDQQLLGIWGCSGKLICTTAVPWNSSWS
NKSHEEIWNNMTMQWDREISNYTNIIYNLLEESQNQQERNEKDLLALDS
WKNLWNWFNITNWLWYIKLFIMIVGGLIGLRIIFAVLSIVNRVRQGYSPL
PFQIRTPNPGGPDRLGRIEEDGGEQDKDRSIRLVSGFLALAWDDLRSLCL
FSYHRLRDFILVTARVVELLGRSSLRGLQKGWEALKYLGSLVQYWGLELK
KSATSLFDTIAIAVAEGTDRIIELGLSICRAIRHIPRRIRQGFEAALQ 3301_V1_C24 (Clade AC)
(SEQ ID NO: 21)
ATEKLWVTVYYGVPVWREAKATLFCASDAKAYDTEVHNVWATHACVPTDP
NPQEIILENVTENFNMWKNNMVEQMHEDIISLWDQSLKPCVKLTPLCVTL
NCTDVTVNGTIVKVNSTGMKNCSFNITTEIRDKKKKESALFYRLDIVPLD
ESSDSSSNYSEYRLISCNTSTITQACPKVTFDPIPIHYCAPAGYAILKCN
NKTFNGLGPCNNVSTVQCTHGIKPVVSTQLLLNGSLAEEEIIIRSENLTD
NVKTIIVHLNDSVPITCTRPNNNTRKSMRIGPGQTFYATGEIIGDIRQAH
CNITRNKWNETLERIKRKLREHFPNKTIEFKPSSGGDPEITTHSFNCNGE
FFYCNTSGLFNAEEANITDITLPCRIRQIINMWQGVGRAIYAPPIAGNIT
CTSDITGLLLTRDGGSDGNSTKETFRPGGGDMRDNWRSELYKYKVVEIKP
LGVAPTKAKRRVVEREKRAVGIGAVFFGFLGAAGSTMGAASITLTVQARQ
LLSGIVQQQSNLLRAIEAQQHMLQLTVWGIKQLQTRVLAIERYLKDQQLL
GIWGCSGKLICTTTVPWNSSWSNKTQNDIWDNMTWMQWDREINNYTNTIY
RLLEESQNQQEKNEQDLLALDKWDNLWSWFSITKWLWYIKIFIMIVGGLI
GLRIIFAVLSIVNRVRQGYSPLSFQTLIPSPREPDRPGRIEEEGGEQDRN
RSTRLVSGFLALAWDDLRSLCLFSYHLLRDFILIAARTVELLGRSSLRGL
QRGWETLKYLGSLVQYWGLELKKSAISLFDTIAIHVAEGTDRIIELVQGI
CRAIYNIPVRIRQGFEAALQ T250-4 (Clade AE)
(SEQ ID NO: 22)
MRVMGIQRNYPPLWRWGTMIFWMMMLCSAEKLWVTVYYGVPVWREADTTL
FCASDAKGYDTEAHNVWATHACVPTDPRPQEMYLENVTENFNMWKNSMVE
QMHTDIISLWDESLKPCVKLTPLCVTLDCQAFNSSSHTNSSIAMQEMKNC
SFNVTTELRDKKKKEYSFFYKTDIEQINKNGRQYRLINCNTSAITQACPK
VSFEPIPIHFCAPAGFAILKCNEKHFNGKGPCKNVSTVQCTHGIKPVVST
QLLLNGSLAEEEVVIRVENTIDNAKTIIVQLAKPVKINCTRPNNNTRKSI
RIGPGQTFYATGDIIGNIRKAYCNVSKREWNNTLQQVAAQLSKSFNNTKI
VFEKHSGGDLEVITHSFVCGGEFFYCNTSGLFNSTWTNSTWTNSTTGSNG
TESNDTITLQCEIKQFINMWQRVGRAMYAPPIPGVIRCESDITGLLLTRD
GPNSTQNETFRPGGGDMRDNWRSELYKYKVVQIEPLGVAPTHAKRRVVER
EKRAVGLGAVFFGFLGAAGSTMGAASITLTVQARQLLSGIVQQQSNLLKA
IEAQQQLLRLTVWGIKQLQARVLALERYLKDQQLLGIWGCSGKLICTTTV
PWNSSWSNKNYTDIWDNMTWLQWDREISNYTDEIYRLIEQSQNQQEKNEQ
DLLALDKWASLWNWFDITNWLWYIKIFIMIVGGLIGLRIIFTVLNVINRV
RQGYSPLSFQTLTHHQREPDRPERIEEGGGEQDRDRSVRLVSGFLALAWD
DLRSLCLFSFHRLRDLVLIAARGVELLGHSSLKGLRLGWEALKLLGNLLS
YWGQELKNSAINLLDAVAIAVANWTDRVIKIGQRAGRAILNIPIRIRQGL
ERALL JRFL (Clade B)
(SEQ ID NO: 23)
MRVKGIRKSYQYLWKGGTLLLGILMICSAVEKLWVTVYYGVPVWKEATTT
LFCASDAKAYDTEVHNVWATHACVPTDPNPQEVVLENVTEHFNMWKNNMV
EQMQEDIISLWDQSLKPCVKLTPLCVTLNCKDVNATNTTNDSEGTMERGE
IKNCSFNITTSIRDEVQKEYALFYKLDVVPIDNNNTSYRLISCDTSVITQ
ACPKISFEPIPIHYCAPAGFAILKCNDKTFNGKGPCKNVSTVQCTHGIRP
VVSTQLLLNGSLAEEEVVIRSDNFTNNAKTIIVQLKESVEINCTRPNNNT
RKSIHIGPGRAFYTTGEIIGDIRQAHCNISRAKWNDTLKQIVIKLREQFE
NKTIVFNHSSGGDPEIVMHSFNCGGEFFYCNSTQLFNSTWNNNTEGSNNT
EGNTITLPCRIKQIINMWQEVGKAMYAPPIRGQIRCSSNITGLLLTRDGG
INENGTEIFRPGGGDMRDNWRSELYKYKVVKIEPLGVAPTKAKRRVVQRE
KRAVGIGAVFLGFLGAAGSTMGAASMTLTVQARLLLSGIVQQQNNLLRAI
EAQQRMLQLTVWGIKQLQARVLAVERYLGDQQLLGIWGCSGKLICTTAVP
WNASWSNKSLDRIWNNMTWMEWEREIDNYTSEIYTLIEESQNQQEKNEQE
LLELDKWASLWNWFDITKWLWYIKIFIMIVGGLVGLRLVFTVLSIVNRVR
QGYSPLSFQTLLPAPRGPDRPEGIEEEGGERDRDSGRLVNGFLALIWVD
LRSLCLFSYHRLRDLLLTVTRIVELLGRRGWEVLKYWWNLLQYWSQELKN
SAVSLLNATAIAVAEGTDRIIEALQRTYRAILHIPTRIRQGLERALL 45_01dG5
(SEQ ID NO: 24)
MRVMGIRKNCQRLWRGGTLFLGILMIFSAAENLWVTVYYGVPVWKEATAT
LFCASDAKAYETEVHNVWATHACVPTDPNPQEVVLENVTENFNMWKNNMV -continued

EQMHEDIISLWDQSLKPCVKLTPLCVTLNCTDYLGNATNTTSSSGGAMEG

GEIKNCSFNITTSMRDKMQKEYALFYKLDVVSIDNDNASTNYRLISCNTS

VITQACPKISFEPIPIHYCAPAGFAILKCNDKKFNGTGPCTNVSTVQCTH

GIRPVVSTQLLLNGSLAEEEIVIRSENIKDNAKIIIVQLNETVEINCTRP

NNNTRKSIPIGPGRAFYTTGAIIGDIRQAHCNISKAKWENTLKQIARKLR

EHFKNETIAFNQSSGGDPEIVMHSFNCGGEFFYCNSTQLFNSTWTWNDTE

VVVNTEKNINITLPCRIKQIINMWQEVGKAMYAPPIKGQIRCSSNITGLL

LTRDGGSSTNGTTETFRPGGGDMRDNWRSELYKYKVVKIEPLGLAPTRAK

RRVVQREKRAVGIGAVFLGFLGAAGSTMGAASMTLTVQARLLLSGIVQQQ

NNLLRAIEAQQHLLQLTVWGIKQLQARVLAVERYLKDQQLLGIWGCSGKL

ICTTAVPWNASWSNKSLDKIWNNMTWMEWEREINNYTGLIYNLIEESQNQ

QEKNEQELLELDKWASLWNWFDITKWLWYIKIFIMIVGGLVGLRIIFTVL

SIVNRVRQGYSPLSFQTHLPAPRGPDRPEGIGEEGGEQDRDRSDRLVTGF

LAIFWVDLRSLCLFSYHRLRDLLLIVTRIVELLGRRGWEILKYWWNLLQY

WNQELKNSAVSLLNATAIVVAEGTDRVIEVLQRAFRAVLNIPTRIRQGLE

RALL

426c (SEQ ID NO: 25)
MDAMKRGLCCVLLLCGAVFVSPSASVGNLWVTVYYGVPVWKEAKTTLFCA

SDAKAYEKEVHNVWATHACVPTDPNPQEVVLENVTENFNMWKNDMVDQMQ

EDVISIWDQSLKPCVKLTPLCVTLNCTNVNVTSNSTNVNSSSTDNTTLGE

IKNCSFDITTEIRDKTRKEYALFYRLDIVPLDNSSNPNSSNTYRLINCNT

STLTQACPKVTFDPIPIHYCAPAGYAILKCNNKTFNGKGPCNNVSTVQCT

HGIKPVVSTQLLLNGSLAEEEIVIRSKNLSDNAKIIIVQLNKSVEIVCTR

PNNNTRRSIRIGPGQTFYATDIIGDIRQAYCNISGRNWSEAVNQVKKKLK

EHFPHKNISFQSSSGGDLEITTHSFNCGGEFFYCNTSGLFNDTISNATIM

LPCRIKQIINMWQEVGKAIYAPPIKGNITCKSDITGLLLLRDGGNTTNNT

EIFRPGGGDMRDNWRSELYKYKVVEIKPLGVAPTDAKSSVVESNKSAVGI

GAVFLGFLGAAGSTMGAASITLTVQARQLLSGIVQQQSNLLRAIEAQQHM

LQLTVWGIKQLQTRVLAIERYLKDQQLLGLWGCSGKLICTTAVPWNISWS

NKSKEEIWENMTWMQWDREINNYTNTIYRLLEESQNQQENNEKDLLALDS

WNNLWNWFNITNWLWYIK

The ectodomain of any of the above HIV-1 Env sequences can be included on a recombinant insect ferritin heavy or light chain fusion protein as described herein to generate a recombinant insect ferritin nanoparticle including the HIV-1 Env ectodomain in trimeric form. In some embodiments the HIV-1 Env ectodomain comprises a gp120 polypeptide and a gp41 ectodomain including amino acid sequences having at least 75% (for example at least 85%, 90%, 95%, 96%, 97%, 98% or 99%) sequence identity to a corresponding native HIV-1 gp120 or gp41 ectodomain polypeptide sequence (e.g., a native gp120 or gp41 ectodomain protein sequence from a clade A, B, C, D, F, G, H, J or K HIV-1 Env protein), such a native HIV-1 sequence set forth above. In the recombinant insect ferritin nanoparticle, the signal peptide of the HIV-1 Env ectodomain is typically not included as this sequence is removed by proteolytic processing when the ectodomain is expressed in a cell.

The HIV-1 Env ectodomain included on the recombinant insect ferritin nanoparticle can include one or more modifications (e.g., cysteine substitutions that can form a disulfide bond to stabilize the HIV1 Env protein in a prefusion closed mature conformation) from a native HIV-1 Env protein sequence that has been determined to stabilize the HIV-1 Env ectodomain in a conformation that induces production of broadly neutralizing antibodies when administered to a subject, for example broadly neutralizing antibodies that specifically bind the V1V2 domain of HIV-1 Env. For example, in some embodiments, an HIV-1 Env (or fragment thereof) sequence from a CAP256.SU, BB201.B42, KER2018.11, CH070.1, ZM233.6, Q23.17, A244, T250-4, or WITO.33 strain of HIV-1 is mutated to include one or more of the disclosed amino acid substitutions to generate a recombinant HIV Env protein (or fragment thereof, such as a gp140 or gp145 protein) that is stabilized in a prefusion mature closed conformation. For example, in some non-limiting embodiments, cysteine substitutions at positions 201 and 433, and the SOSIP mutations, are made to a gp140 sequence from a CAP256.SU, BB201.B42, KER2018.11, CH070.1, ZM233.6, Q23.17, A244, T250-4, or WITO.33 strain of HIV-1 to generate the recombinant HIV-1 Env ectodomain that can form a trimer stabilized in the prefusion mature closed conformation.

In several embodiments, the recombinant HIV-1 Env ectodomain includes a gp120 polypeptide and a gp41 ectodomain, wherein the n-terminal residue of the gp120 polypeptide is one of HIV-1 Env positions 1-35; the c-terminal residue of the gp120 polypeptide is one of HIV-1 Env positions 503-511; the n-terminal residue of the gp41 ectodomain is one of HIV-1 Env positions 512-522; and the c-terminal residue of the gp41 ectodomain is one of HIV-1 Env positions 624-705. In one non-limiting example, the recombinant HIV-1 Env ectodomain includes a gp120 polypeptide and a gp41 ectodomain, wherein the n- and c-terminal residues of the gp120 polypeptide are HIV-1 Env positions 31 and 511, respectively; and the n- and c-terminal residue of the gp41 polypeptide are HIV-1 Env positions 512 and 664, respectively. In some embodiments, the C-terminal residue of the recombinant HIV-1 Env ectodomain is position 683 (the entire ectodomain, terminating just before the transmembrane domain).

In several embodiments, the recombinant HIV-1 Env ectodomain trimer includes one or more non-natural disulfide bonds that stabilize the HIV-1 Env ectodomain trimer in the prefusion mature closed conformation. Exemplary amino acid substitutions that can be used to stabilize the HIV-1 Env ectodomain trimer in the prefusion closed mature conformation are disclosed in PCT. App. No. PCT/US2015/048729 (such as in Table 13 of this PCT application), which is incorporated by reference herein in its entirety. Any of these stabilizing amino acid substitutions can be included an HIV-1 Env ectodomain included on a disclosed recombinant insect ferritin nanoparticle. In one non-limiting example, the recombinant HIV-1 Env ectodomain comprises the "DS" cysteine substitutions at positions 201 and 433 (HXB2 numbering, e.g., the "DS" substitutions of I201C and A433C). In additional examples, the recombinant HIV-1 Env ectodomain comprises cysteine substitutions at positions 201 and 433 (e.g., I201C and A433C substitutions) and further include the SOS (501C and 605C), IP (559P), and/or SOSIP (501C, 605C, 559P) substitutions.

In some embodiments, the HIV-1 Env ectodomain included on the recombinant insect ferritin nanoparticle can be a single chain HIV-1 Env ectodomain including gp120 and the gp41 ectodomain in a single polypeptide chain. A single chain HIV-1 Env ectodomain does not include the furin cleavage site separating gp120 and gp41; therefore, when produced in cells, the Env ectodomain is not cleaved into separate gp120 and gp41 ectodomain polypeptides. For example, the gp120 and gp41 proteins can be linked by a peptide linker, or directly linked. Non-limiting examples of peptide linkers that can be used include glycine, serine, and glycine-serine linkers (such as a 10 amino acid gly-ser linker between HIV-1 Env residues 507 and 512). In some embodiments, the single chain HIV-1 protein comprises a heterologous peptide linker between HIV-1 Env residues 507 and 512, 503 and 519, 504 and 519, 503 and 522, or 504 and 522. In some embodiments, the single chain HIV-1 protein comprises a heterologous peptide linker between HIV-1 Env residues 507 and 512.

In some embodiments, the recombinant HIV-1 Env ectodomain can further include an N-linked glycosylation site at gp120 position 332 (if not already present on the ectodomain). For example, by T332N substitution in the case of BG505 based immunogens. The presence of the glycosylation site at N332 allows for binding by 2G12 antibody.

In some embodiments, the recombinant HIV-1 Env ectodomain comprises a lysine residue at gp120 position 168 (if not already present on the ectodomain). For example, the lysine residue can be added by amino acid substitution (such as an E168K substitution in the case of the JR-FL based immunogens). The presence of the lysine residue at position 168 allows for binding of particular broadly neutralizing antibodies to the V1V2 loop of gp120.

In some embodiments, the recombinant HIV-1 Env ectodomain comprises an arginine residue at gp120 position 368 (if not already present on the ectodomain). For example, the arginine residue can be added by amino acid substitution (such as a D368R substitution). The presence of the arginine residue at position 368 reduces binding of CD4 to the HIV-1 Env ectodomain to inhibit the trimer from adopting the CD4-bound conformation.

In some embodiments, the recombinant HIV-1 Env ectodomain can be further modified to include the "R6" mutation, which provides six Arginine residues in place of the native furin cleavage site between gp120 and gp41.

Chimeric Env Ectodomains

In some embodiments, a recombinant HIV-1 Env ectodomain included on a disclosed recombinant insect ferritin nanoparticle comprises sequences from multiple strains of HIV-1. Non-limiting examples of sequences of chimeric HIV-1 Env ectodomains for use with the disclosed embodiments are provided in PCT. App. No. PCT/US2015/048729. For example, the recombinant HIV-1 Env ectodomain comprises a gp120 sequence from a first HIV-1 strain and a gp41 sequence from a heterologous HIV-1 strain, or a particular structural domain (such as the V1V2 domain) from a HIV-1 strain of interest (such as CAP256.SU, a BB201.B42, a KER2018.11, a CH070.1, a ZM233.6, a Q23.17, a A244, a T250-4, or a WITO.33) with the remainder of the HIV-1 Env ectodomain from a heterologous HIV-1 strain (such as BG505). The chimeric HIV-1 Env ectodomain can further include any of the amino acid substitutions described herein, for example the 201C/433C, SOSIP, and DS substitutions for stabilization in the prefusion mature closed conformation. In the context of inducing an immune response in a subject that can control infection across multiple HIV-1 strains, the use of immunogens based on diverse HIV-1 strains can overcome the intrinsic sequence diversity of HIV-1 Env.

Exemplary sequences of chimeric HIV-1 Env ectodomain trimers that include the V1V2 domain sequence (positions 126-196) of the CAP256.SU, BB201.B42, KER2018.11, CH070.1, ZM233.6, Q23.17, A244, T250-4, or WITO.33 strains of HIV-1, with the remainder including BG505.SOSIP.DS.368R sequence, are provided in PCT. App. No. PCT/US2015/048729 (such as in Table 13 of this PCT application), which is incorporated by reference herein in its entirety.

Platform

Prefusion mature gp41 wraps its hydrophobic core around extended N- and C-termini-strands of gp120. Accordingly, in some embodiments, the recombinant HIV-1 Env ectodomain trimer comprises a membrane proximal "platform" including the N- and C-terminal regions of gp120, and the gp41 ectodomain, from a first HIV-1 strain (such as BG505), and the remainder of gp120 from one or more heterologous HIV-1 strains. This chimeric design allows for production of heterogeneous HIV-1 Env proteins that comprise membrane distal features of interest (such as the V1V2 domain, V3 domain, and CD4 binding site).

In some embodiments, the recombinant Env ectodomain includes N- and C-terminal regions of gp120 as well as the gp41 ectodomain from a first HIV-1 strain (such as BG505, for example, with SOSIP substitutions), and the remainder of gp120 from a heterologous HIV-1 strain. In some embodiments, the heterologous HIV-1 strain can be a subtype A (such as BI369.9A, MB201.A1, QH209.14M.A2), subtype B (such as AC10.29), subtype C (such as 0921.V2.C14, 16055-2.3, 25925-2.22, 286.36, CAP45.G3, CNE58, DU156.12, DU422.01, MW965.26, ZM53.12, ZM55.28a, ZM106.9), subtype CRF AC (such as 3301.V1.C24, 6545.V4.C1), subtype CFR AE (such as 620345.cl, C1080.c3, C4118.09, CNE55, TH966.8), or subtype CRF BC (such as CH038.12, CH117.4) strain of HIV-1.

In some embodiments, the recombinant HIV-1 Env ectodomain comprises a gp41 ectodomain, an N-terminal region of the gp120 polypeptide comprising a β-4 strand and a C-terminal region of the gp120 polypeptide comprising a β26 strand from a first strain of HIV-1 (such as BG505), and all or a portion of the remaining residues of the gp120 polypeptide are from one or more heterologous HIV-1 strains. The heterologous strain can be, for example, one of CAP256.SU, a BB201.B42, a KER2018.11, a CH070.1, a ZM233.6, a Q23.17, a A244, a T250-4, a WITO.33, a 426c (with N276D, N460D, N463D), a d45-01dG5, or a JRFL strain of HIV-1. In additional embodiments, the N-terminal region of the gp120 polypeptide can further include the β-3 strand from the first HIV-1 strain (such as BG505). In more embodiments the C-terminal region of the gp120 polypeptide can further include the β25 strand or the β25 strand and all or a portion of the α5 helix from the first HIV-1 strain (such as BG505). In more embodiments, the N-terminal region of the gp120 polypeptide comprises from 5 to 30 (such as 10, 30, 5-20, 5-25, 5-15, 5-10, 10-20, 20-30, 15-25, or 5, 10, 15, 20, 25) amino acids and/or the C-terminal region of the gp120 polypeptide comprises from 5-40 (such as 10-40, 5-30, 5-25, 5-20, 10-20, 20-30, 30-40, 10-30, 20-40, or 5, 10, 15, 20, 25, 30, or 35) amino acids, from the N- or C-terminus of the gp120 polypeptide, respectively, from the first strain of HIV-1 (such as BG505). Any of the stabilizing amino acid substitutions (such as the SOSIP substitutions, and/or the 201C/433C substitutions) can be included in the chimeric HIV-1 Env ectodomain.

In some embodiments, the recombinant Env ectodomain comprises gp120 residues 31-45 and 478-507, and gp41 residues (e.g., 512-664) from the first HIV-1 strain (such as BG505), and the remainder of the gp120 residues in the Env protein can be from a heterologous HIV-1 strain. For example, the recombinant Env ectodomain comprises gp120 positions 31-45 and 478-507, and gp41 residues (e.g., 512-664) from the BG505 strain with SOSIP substitution, and the remaining gp120 residues in the Env ectodomain can be from any one of the CAP256.SU, BB201.B42, KER2018.11, CH070.1, ZM233.6, Q23.17, A244, WITO.33, JRFL, 426c (with N276D, N460D, N463D), d45-01dG5, BI369.9A, MB201.A1, QH209.14M.A2, 0921.V2.C14, 16055-2.3, 25925-2.22, 286.36, CAP45.G3, DU156.12, DU422.01, MW965.26, ZM53.12, ZM55.28a, ZM106.9, 3301.V1.C24, 6545.V4.C1, 620345.cl, C1080.c3, C4118.09, CNE55, TH966.8, AC10.29, CH038.12, CNE58, or CH117.4 strains of HIV-1. Any of the stabilizing amino acid substitutions (such as the SOSIP substitutions, and/or the 201C/433C substitutions) can be included in the chimeric HIV-1 Env ectodomain.

Additional Description of Chimeric Ectodomains

In some embodiments, the chimeric HIV-1 Env ectodomain can further include additional structural domains or elements from the first HIV-1 strain (such as BG505) in place of those of the heterologous strain, for example, strand C of the V1V2 domain (such as gp120 positions 166-173), a V3 domain (such as gp120 positions 296-331), a V2 loop (such as gp120 positions 154-205), a V1 loop (such as gp120 positions 119-153), positions 191-205. In some embodiments, the chimeric HIV-1 Env ectodomain comprises from the first HIV-1 strain (such as BG505): a V2 loop and a V3 loop; a Strand C of the V1V2 domain and a V3 domain; positions 191-205 and a Strand C of the V1V2 domain; a V1 loop and a V3 domain; a V1 loop, a Strand C of the V1V2 domain, and a V3 domain; a V1 loop, a V2 loop, and a V3 domain; or a V1V2 domain.

Chimeras of Three Strains

In additional embodiments, the recombinant HIV-1 Env ectodomain trimer can be a chimera having unique antigenic characteristics that provide for binding to mature and unmutated common ancestor (UCA) forms of multiple classes of broadly neutralizing antibodies (e.g., targeting the CD4 binding site and the V1V2 domain). Such recombinant HIV-1 Env ectodomain trimers are of particular interest for use as a "prime" immunogen in a prime-boost immunization protocol for eliciting an immune response to HIV-1 Env.

For example, in some embodiments, the recombinant HIV-1 Env ectodomain trimer can be a chimera comprising amino acid sequences from three HIV-1 strains, including a membrane proximal "platform" from a first strain, a V1V2 domain from a second strain, and the remainder from a heterologous strain. In a non-limiting example, the V1V2 domain can be from an Env protein (such as one of CAP256.SU, BB201.B42, KER2018.11, CH070.1, ZM233.6, Q23.17, A244, T250-4, or WITO.33) that binds to a UCA form of a broadly neutralizing antibody (e.g., VRC26 or PGT145). The remainder sequences of the chimera can also be from an Env protein that binds to a UCA form of a broadly neutralizing antibody (such as 45_01 dG5 or 426c with amino acid substitutions to remove N-linked glycan sequons at positions 276, 460, 463). The sequences of the first, second, and heterologous strains can be further modified to include the one or more amino acid substitutions that stabilize the recombinant HIV-1 Env ectodomain trimer in the prefusion mature closed conformation (such as SOS, IP, and DS substitutions), and can also include additional substitutions as needed, for example, substitutions to increase protease cleavage (such as the R6 substitution), or to increase or decrease the desired number of glycans (such as addition of glycan sequons at positions 504 and 661, and/or at position 332).

In some embodiments, the recombinant HIV-1 Env ectodomain trimer can be a chimera comprising amino acid sequences from three HIV-1 strains, wherein the recombinant HIV-1 Env ectodomain includes (1) a gp41 ectodomain (such as positions 512-664), an N-terminal region of the gp120 polypeptide comprising a β-4 strand, and a C-terminal region of the gp120 polypeptide comprising a β26 strand, from a first strain of HIV-1 (such as BG505), (2) a V1V2 domain (such as gp120 positions 126-196) of the gp120 polypeptide from a second strain of HIV-1 (such as one of CAP256.SU, BB201.B42, KER2018.11, CH070.1, ZM233.6, Q23.17, A244, T250-4, or WITO.33; and (3) the remaining sequence of the gp120 polypeptide from a heterologous strain of HIV-1 (such as 45_01 dG5 or 426c with amino acid substitutions to remove N-linked glycan sequons at positions 276, 460, 463). In some such embodiments, the N-terminal region of the gp120 polypeptide can further comprises a β-3 strand from the first HIV-1 strain; and the C-terminal region of the gp120 polypeptide further comprises a β25 strand or a β25 strand and a α5 helix from the first HIV-1 strain. In additional embodiments, the N- and C-terminal regions of the gp120 polypeptide comprise gp120 positions 31-45 and 478-508, respectively. The gp120 polypeptide can further comprises positions 46-54, 70-75, 84-89, 99, 102, 106, 107, 114, 215, 220-224, 226, 244, 471-473, and 476-477 from the first HIV-1 strain. The sequences of the first, second, and heterologous strains are further modified to comprise the one or more amino acid substitutions that stabilize the recombinant HIV-1 Env ectodomain trimer in the prefusion mature closed conformation.

In some embodiments, the second and heterologous strains are respectively one of: CAP256.SU and 426c; BB201.B42 and 426c; KER2018.11 and 426c; CH070.1 and 426c; ZM233.6 and 426c; Q23.17 and 426c; A244 and 426c; T250-4 and 426c; WITO.33 and 426c; CAP256.SU and 4501dG5; BB201.B42 and 45_01dG5; KER2018.11 and 45_01dG5; CH070.1 and 45_01dG5; ZM233.6 and 45_01 dG5; Q23.17 and 45_01 dG5; A244 and 45_01 dG5; T250-4 and 45_01 dG5; or WITO.33 and 45_01 dG5; and wherein the 426c strain further comprises amino acid substitutions to remove the N-linked glycan sequons at positions 276, 460, 463. The sequences of the first, second, and heterologous strains are further modified to include the one or more amino acid substitutions that stabilize the recombinant HIV-1 Env ectodomain trimer in the prefusion mature closed conformation (such as SOS, IP, and DS substitutions), and can also include additional substitutions as needed, In some embodiments, the second HIV-1 strain (providing the V1V2 domain) can be one of BI369.9A, MB201.A1, QH209.14M.A2, 0921.V2.C14, 16055-2.3, 25925-2.22, 286.36, CAP45.G3, DU156.12, DU422.01, MW965.26, ZM53.12, ZM55.28a, ZM106.9, 3301.V1.C24, 6545.V4.C1, 620345.cl, C1080.c3, C4118.09, CNE55, TH966.8, AC10.29, CH038.12, CNE58, CH117.4, CAP256.SU, BB201.B42, KER2018.11, CH070.1, ZM233.6, Q23.17, A244, T250-4, WITO.33, or JRFL. For example, the second HIV-1 strain can be one of CAP256.SU, BB201.B42, KER2018.11, CH070.1, ZM233.6, Q23.17, A244, T250-4, WITO.33, and JRFL.

Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided as SEQ ID NOs: 2146-2159 of PCT. App. No. PCT/US2015/048729. Thus, in some embodiments, the recombinant HIV-1 Env ectodomain comprises an amino acid sequence set forth as any one of SEQ ID NOs: 2146, 2147, 2148, 2149, 2150, 2151, 2152, 2153, 2154, 2155, 2156, 2157, 2158, or 2159 of PCT. App. No. PCT/US2015/048729, or an amino acid sequence at least 80% (such as at least 90%, at least 95%, at least 96%, at least 97%, at least 98%, or at least 99%) identical to any one of SEQ ID NOs: 2146, 2147, 2148, 2149, 2150, 2151, 2152, 2153, 2154, 2155, 2156, 2157, 2158, or 2159 of PCT. App. No. PCT/US2015/048729.

Sequences of exemplary insect ferritin heavy and light chain fusion proteins including heavy or light chain ferritin subunits fused to HIV-1 Env ectodomains are provided below:

CNE58-chim_5ln_iFerr-L-nt30
(SEQ ID NO: 26)
AENLWVTVYYGVPVWKEAKTTLFCASDAKAYETEVHNVWATHACVPTDPN
PQEMVLENVTENFNMWKNEMATQMHEDVISLWDQSLKPCVKLTPLCVTLD
CKNVTLNCGNDTSGNDTLECEKGTNNETYDESVKELRNCSFNATTEVRDK
KKKEYALFYSLDIVPLKNSSEQYRLISCDTSAITQACPKVTFDPIPIHYC
TPAGYAILKCNNKTFNGTGPCNNVSTVQCTHGIKPVVSTQLLLNGSLAEE
EIIVRSENITNNVKTIIVHLNQSVEIVCTRPNNNTRKSIRIGPGQTFYAT
GEIIGDIRQAHCNITKSNWHKTLQEVSKKLAGYFPNKTIIFNSSSGGDLE
ITTHSFNCRGEFFYCNTSSLFNSTYMSNGTYMFNDMSNGTERNSSSIIAI
PCRIKQVINMWQEVGRAMYAPPIAGKLTCRSNITGLLLVRDGGTNNATTE
TFRPGGGDMRNNWRSELYKYKVVKIEPLGVAPTRCKRRVVGRRRRRAVG
IGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD
ggsggEYGSHGNVATELQAYAKLHLERSYDYLLSAAYFNNYQTNRAGFSK
LFKKLSDEAWSKTIDIIKHVTKRGDKMNFDQHSTMKTERKNYTAENHELE
ALAKALDTQKELAERAFYIHREATRNSQHLHDPEIAQYLEEEFIEDHAEK
IRTLAGHTSDLKKFITANNGHDLSLALYVFDEYLQKTV CNE58-chim_8ln_iFerr-L-nt30
(SEQ ID NO: 27)
AENLWVTVYYGVPVWKEAKTTLFCASDAKAYETEVHNVWATHACVPTDPN
PQEMVLENVTENFNMWKNEMATQMHEDVISLWDQSLKPCVKLTPLCVTLD
CKNVTLNCGNDTSGNDTLECEKGTNNETYDESVKELRNCSFNATTEVRDK
KKKEYALFYSLDIVPLKNSSEQYRLISCDTSAITQACPKVTFDPIPIHYC
TPAGYAILKCNNKTFNGTGPCNNVSTVQCTHGIKPVVSTQLLLNGSLAEE
EIIVRSENITNNVKTIIVHLNQSVEIVCTRPNNNTRKSIRIGPGQTFYAT
GEIIGDIRQAHCNITKSNWHKTLQEVSKKLAGYFPNKTIIFNSSSGGDLE
ITTHSFNCRGEFFYCNTSSLFNSTYMSNGTYMFNDMSNGTERNSSSIIAI
PCRIKQVINMWQEVGRAMYAPPIAGKLTCRSNITGLLLVRDGGTNNATTE
TFRPGGGDMRNNWRSELYKYKVVKIEPLGVAPTRCKRRVVGRRRRRAVG
IGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD
ggsgggsgEYGSHGNVATELQAYAKLHLERSYDYLLSAAYFNNYQTNRAG
FSKLFKKLSDEAWSKTIDIIKHVTKRGDKMNFDQHSTMKTERKNYTAENH
ELEALAKALDTQKELAERAFYIHREATRNSQHLHDPEIAQYLEEEFIEDH
AEKIRTLAGHTSDLKKFITANNGHDLSLALYVFDEYLQKTV CNE58-chim_2ln_iFerr-H-nt19
(SEQ ID NO: 28)
AENLWVTVYYGVPVWKEAKTTLFCASDAKAYETEVHNVWATHACVPTDPN
PQEMVLENVTENFNMWKNEMATQMHEDVISLWDQSLKPCVKLTPLCVTLD
CKNVTLNCGNDTSGNDTLECEKGTNNETYDESVKELRNCSFNATTEVRDK
KKKEYALFYSLDIVPLKNSSEQYRLISCDTSAITQACPKVTFDPIPIHYC
TPAGYAILKCNNKTFNGTGPCNNVSTVQCTHGIKPVVSTQLLLNGSLAEE
EIIVRSENITNNVKTIIVHLNQSVEIVCTRPNNNTRKSIRIGPGQTFYAT
GEIIGDIRQAHCNITKSNWHKTLQEVSKKLAGYFPNKTIIFNSSSGGDLE
ITTHSFNCRGEFFYCNTSSLFNSTYMSNGTYMFNDMSNGTERNSSSIIAI
PCRIKQVINMWQEVGRAMYAPPIAGKLTCRSNITGLLLVRDGGTNNATTE
TFRPGGGDMRNNWRSELYKYKVVKIEPLGVAPTRCKRRVVGRRRRRAVG
IGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD
ggRSCRNSMRQQIQMEVGASLQYLAMGAHFSKDVVNRPGFAQLFFDAASE
EREHAMKLIEYLLMRGELTNDVSSLLQVRPPTRSSWKGGVEALEHALSME
SDVTKSIRNVIKACEDDSEFNDYHLVDYLTGDFLEEQYKGQRDLAGKAST
LKKLMDRHEALGEFIFDKKLLGIDV CNE58-chim_5ln_iFerr-H-nt19
(SEQ ID NO: 29)
AENLWVTVYYGVPVWKEAKTTLFCASDAKAYETEVHNVWATHACVPTDPN
PQEMVLENVTENFNMWKNEMATQMHEDVISLWDQSLKPCVKLTPLCVTLD
CKNVTLNCGNDTSGNDTLECEKGTNNETYDESVKELRNCSFNATTEVRDK
KKKEYALFYSLDIVPLKNSSEQYRLISCDTSAITQACPKVTFDPIPIHYC
TPAGYAILKCNNKTFNGTGPCNNVSTVQCTHGIKPVVSTQLLLNGSLAEE
EIIVRSENITNNVKTIIVHLNQSVEIVCTRPNNNTRKSIRIGPGQTFYAT
GEIIGDIRQAHCNITKSNWHKTLQEVSKKLAGYFPNKTIIFNSSSGGDLE
ITTHSFNCRGEFFYCNTSSLFNSTYMSNGTYMFNDMSNGTERNSSSIIAI
PCRIKQVINMWQEVGRAMYAPPIAGKLTCRSNITGLLLVRDGGTNNATTE
TFRPGGGDMRNNWRSELYKYKVVKIEPLGVAPTRCKRRVVGRRRRRAVG
IGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD
ggsggRSCRNSMRQQIQMEVGASLQYLAMGAHFSKDVVNRPGFAQLFFDA
ASEEREHAMKLIEYLLMRGELTNDVSSLLQVRPPTRSSWKGGVEALEHAL

SMESDVTKSIRNVIKACEDDSEFNDYHLVDYLTGDFLEEQYKGQRDLAGK

ASTLKKLMDRHEALGEFIFDKKLLGIDV

DU422.01.sosip.201C-433C_iFerr-H-nt19_5ln
(SEQ ID NO: 30)
AENLWVTVYYGVPVWKEAKTTLFCASDAKAYDKEVHNVWATHACVPTDPN

PQEIVLENVTENFNMWKNDMVDQMHEDIISLWDQSLKPCVKLTPLCVTLN

CKNVNISANANATATLNSSMNGEIKNCSFNTTTELRDKKQKVYALFYKPD

VVPLNGGEHNETGEYILINCNSSTCTQACPKVSFDPIPIHYCAPAGYAIL

KCNNKTFNGTGPCNNVSTVQCTHGIKPVVSTQLLLNGSLAEEEIIVRSEN

LTNNIKTIIVHLNKSVEIKCTRPNNNTRKSVRIGPGQTFYATGEIIGDIR

EAHCNISRETWNSTLIQVKEKLREHYNKTIKFEPSSGGDLEVTTHSFNCR

GEFFYCDTTKLFNETKLFNESEYVDNKTIILPCRIKQIINMWQEVGRCMY

APPIEGNITCKSNITGLLLTWDGGENSTEGVFRPGGGNMKDNWRSELYKY

KVVEIKPLGVAPTKCKRKVVGRRRRRRAVGLGAVLLGFLGAAGSTMGAAS

ITLTVQARQLLSGIVQQQSNLLRAPEAQQHLLQLTVWGIKQLQTRVLAIE

RYLKDQQLLGLWGCSGKLICCTAVPWNSSWSNKSLGDIWDNMTWMQWDRE

ISNYTNTIFRLLEDSQNQQEKNEKDLLALDggsggRSCRNSMRQQIQMEV

GASLQYLAMGAHFSKDVVNRPGFAQLFFDAASEEREHAMKLIEYLLMRGE

LTNDVSSLLQVRPPTRSSWKGGVEALEHALSMESDVTKSIRNVIKACEDD

SEFNDYHLVDYLTGDFLEEQYKGQRDLAGKASTLKKLMDRHEALGEFIFD

KKLLGIDV

ZM106.9.sosip.201C-433C_iFerr-H-nt19_5ln
(SEQ ID NO: 31)
AENLWVTVYYGVPVWKEAKTTLFCASDAKAYEREVHNVWATHACVPTDPS

PQEMVLENVTENFNMWKNDMVDQMHEDIISLWDQSLKPCVKLTPLCVTLK

CVNVNATSKSNASATNDGSGEMKNCTFNITTEIRDKKRNESALFYKLDIV

PLTNDNNSGEYRLINCNTSACTQACPKVSFDPIPIHYCAPAGYAILKCNN

KTFNGTGPCYNVSTVQCTHGIKPVVSTQLLLNGSLAEGEIIIRSENLTDN

VKTIIVHLNESIHITCTRPNNNTRKSIRIGPGQTFYATGEIIGDIRKAYC

NISEEKWNKALQEVGKKLKEHFPNKTIKFAPSSGGDLEITTHSFNCRGEF

FYCNTSKLFNSTYMHNATSRNATNATITLPCRIRQIINMWQEVGRCMYAP

PIAGNITCVSNITGLLLVRDGGNGDTNDTETFRPGGGDMKNNWRSELYKY

KVVEIKPLGVAPTECKRRVVGRRRRRRAVGIGAVLLGFLGAAGSTMGAAS

ITLTAQARQVLSGIVQQQSNLLRAPEAQQHLLQLTVWGIKQLQTRVLALE

RYLKDQQLLGLWGCSGRLICCTAVPWNSSWSNKSLTDIWDNMTWMQWDKE

VSNYTNTIYRLLEDSQSQQEKNEKDLLALDggsggRSCRNSMRQQIQMEV

GASLQYLAMGAHFSKDVVNRPGFAQLFFDAASEEREHAMKLIEYLLMRGE

LTNDVSSLLQVRPPTRSSWKGGVEALEHALSMESDVTKSIRNVIKACEDD

SEFNDYHLVDYLTGDFLEEQYKGQRDLAGKASTLKKLMDRHEALGEFIFD

KKLLGIDV

ZM55.28a.sosip.201C-433C_iFerr-H-nt19_5ln
(SEQ ID NO: 32)
AENLWVTVYYGVPVWKEAKTTLFCASDAKAYEREVHNVWATHACVPTDPN

PQEMVLENVTENFNMWKNDMVDQMHEDIISLWDESLKPCVKLTPLCVTLN

CTFITNTTEIKNCTFNMTTELRDIKQQGRALFDTLDIVPLKPPNNSSNYS

EYRLISCNTSTCTQACPKVSFDPIPIHYCAPAGYAILKCNNKTFNGLGPC

NNVSTVQCTHGIKPVVSTQLLLNGSLAEEEIIRSENLTNNVKTIIVHLN

EPVYIVCTRPNNNTRKSMRIGPGQTFYATGDIIGDIRQAHCNISIEKWNT

TLEKVKERLKKHFPNKIIKFEPSSGGDLEITTHSFNCRGEFFYCNTANLF

NETFMNQTDANQTNATITLQCRIKQIINMWQGVGRCMYAPPIPGRITCNS

SITGLILTRDGGENTTDNGTEIFRPGGGDMRDNWRSELYKYKVVEIKPLG

IAPTECKRRVVGRRRRRRAVGIGAVFLGFLGAAGSTMGAASITLTVQARQ

LLSGIVQQQSNLLRAPEAQQHMLQLTVWGIKQLQARVLAIERYLKDQQLL

GIWGCSGKLICCTNVPWNSSWSNKSLGDIWDNMTWMEWDREISNYTNIIF

GLLEDSQNQQERNEKDLLALDggsggRSCRNSMRQQIQMEVGASLQYLAM

GAHFSKDVVNRPGFAQLFFDAASEEREHAMKLIEYLLMRGELTNDVSSLL

QVRPPTRSSWKGGVEALEHALSMESDVTKSIRNVIKACEDDSEFNDYHLV

DYLTGDFLEEQYKGQRDLAGKASTLKKLMDRHEALGEFIFDKKLLGIDV

DU156.12.sosip.201C-433C_iFerr-H-nt19_5ln
(SEQ ID NO: 33)
AENLWVTVYYGVPVWTEAKTTLFCASDAKAYEKEVHNVWATHACVPTDPN

PQEIFLKNVTENFNMWKNDMVDQMHEDIISLWDQSLKPCVKLTPLCVTLN

CVTYNNSMNSSATYNNSMNGEIKNCSFNTTTELRDKKQKVYALFYRTDVV

PLNNNNNNSEYILINCNTSTCTQACPKVSFDPIPIHYCAPAGYAILKCTD

KKFNGTGSCNNVSTVQCTHGIKPVVSTQLLLNGSLAEEEIIIKSENLTDN

IKTIIVQLNQSIGINCTRPNNNTRKSVRIGPGQTFYATGDIIGDIRQAHC

NISRNQWNETLEQVKKKLGEHFHNQTKIKFEPPSGGDLEITTHSFNCRGE

FFYCNTADLFTNATKLVNDTENKAVITIPCRIKQIINMWQGVGRCMYAPP

IEGNITCNSNITGLLLTRDGGGNVTEINRTEIFRPGGGNMKDNWRNELYK

YKVVEIKPLGVAPTGCKRKVVGRRRRRRAVGLGAVLFGFLGAAGSTMGAA

SITLTAQARQLLSGIVQQQSNLLRAPEAQQHMLQLTVWGIKQLQARVLAI

ERYLKDQQLLGLWGCSGKLICCTNVPWNSSWSNKSQTDIWNNTTWMQWER

EISNYTDTIYRLLEDSQNQQEENEKDLLALDggsggRSCRNSMRQQIQME

VGASLQYLAMGAHFSKDVVNRPGFAQLFFDAASEEREHAMKLIEYLLMRG

ELTNDVSSLLQVRPPTRSSWKGGVEALEHALSMESDVTKSIRNVIKACED

DSEFNDYHLVDYLTGDFLEEQYKGQRDLAGKASTLKKLMDRHEALGEFIF

DKKLLGIDV

0921.V2.C14-chim_201C-433C_5ln_iFerr-H-nt19
(SEQ ID NO: 34)
AENLWVTVYYGVPVWKEAKTTLFCASDAKAYETEVHNIWATHACVPTDPN

PQEMELPNVTENFNMWKNDMVDQMHEDIISLWDQSLKPCVKLTPLCVTLN

CTITNSSSIMTNCTFNTTTELKDKKRKASASFYRLDIVPLNGDSNGSSSG

SYRLINCNTSTCTQACPKVSFDPIPIHYCAPAGYAILKCNDETFNGTGPC

```
HNVSTVQCTHGIKPVVSTQLLLNGSLSEGEIIIRSENLTDNVKTIIVHLN
KSIEINCIRTGNNTRRSIRIGPGQTFYATGDIIGDIRKAYCNISKHIWNK
TLEEVATKLGAHFINKTIKFAPPSGGDLEITTHSFNCRGEFFYCNTTQLF
NNISIGRFNTSIENDTNIILPCRIKQIINMWQEVGRCMYAPPIEGNITCR
SNITGILLTRDGGNGGADNSTETFRPGGGNMKDNWRSELYKYKVVKIEPL
GVAPTRCKRRVVGRRRRRRAVGIGAVFLGFLGAAGSTMGAASMTLTVQAR
NLLSGIVQQQSNLLRAPEAQQHLLKLTVWGIKQLQARVLAVERYLRDQQL
LGIWGCSGKLICCTNVPWNSSWSNRNLSEIWDNMTWLQWDKEISNYTQII
YGLLEESQNQQEKNEQDLLALDggsggRSCRNSMRQQIQMEVGASLQYLA
MGAHFSKDVVNRPGFAQLFFDAASEEREHAMKLIEYLLMRGELTNDVSSL
LQVRPPTRSSWKGGVEALEHALSMESDVTKSIRNVIKACEDDSEFNDYHL
VDYLTGDFLEEQYKGQRDLAGKASTLKKLMDRHEALGEFIFDKKLLGIDV
```

16055-2.3-chim_201C-433C_5ln_iFerr-H-nt19
(SEQ ID NO: 35)
```
AENLWVTVYYGVPVWKEAKTTLFCASDAKAYEKEVHNVWATHACVPTDPN
PQEMVLENVTENFNMWKNDMVEQMHEDVISLWDQSLKPCVKLTPLCVTLE
CRQVNTTNATSSVNVTNGEEIKNCSFNATTEIRDKKQKVYALFYRLDIVP
LEEERKGNSSKYRLINCNTSACTQACPKVTFDPIPIHYCAPAGYAILKCN
NKTFNGTGPCNNVSTVQCTHGIKPVVSTQLLLNGSLAEGEIIIRSENLTN
NVKTIIVHLNESVEIVCTRPNNNTRKSIRIGPGQTFYATGDIIGNIRQAY
CNIKKDDWIRTLQRVGKKLAEHFPRRIINFTSPAGGDLEITTHSFNCRGE
FFYCNTSSLFNSTYNPNDTNSNSSSSNSSLDITIPCRIKQIINMWQEVGR
CMYAPPIEGNITCKSNITGLLLVRDGGVESNETEIFRPGGGDMRNNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggRSCRNSMRQQI
QMEVGASLQYLAMGAHFSKDVVNRPGFAQLFFDAASEEREHAMKLIEYLL
MRGELTNDVSSLLQVRPPTRSSWKGGVEALEHALSMESDVTKSIRNVIKA
CEDDSEFNDYHLVDYLTGDFLEEQYKGQRDLAGKASTLKKLMDRHEALGE
FIFDKKLLGIDV
```

286.36-chim_201C-433C_5ln_iFerr-H-nt19
(SEQ ID NO: 36)
```
AENLWVTVYYGVPVWKEANPTLFCASDAKAYKTEMHNVWATHACVPTDPN
PQEMVLENVTEDFNMWKNGMVEQMHQDIISLWDQSLKPCVKLTPLCVTLN
CTEVTRSSNGTINNNSTEMKNCSFNVTTDLRDKKKKEHALFYRLDIVPLD
ETNGTSSEYRLINCNTSTCTQACPKVSFDPIPIHYCAPAGYAILKCKDKK
FNGTGPCKNVSTVQCTHGIKPVVSTQLLLNGSIAEGEIIIRSENLTNNAK
IIIVQLNVTVEINCTRPNNNTRRSIRIGPGQTFYATGEIIGDIRQAHCNI
SREKWNRTLQKVEKKLEELFPNKTIHFTSSSGGDLEITTHSFNCMGEFFY
CNTSALFNNNNDSTNSNITLPCRIRQFINMWQEVGRCMYAPPIQGVITCK
SNVTGLLLTRDGGIINDTEIFRPGGGDMRDNWRSELYKYKVVKIEPLGVA
PTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLLGI
WGCSGKLICCTNVPWNSSWSNRNLSEIWDNMTWLQWDKEISNYTQIIYGL
LEESQNQQEKNEQDLLALDggsggRSCRNSMRQQIQMEVGASLQYLAMGA
HFSKDVVNRPGFAQLFFDAASEEREHAMKLIEYLLMRGELTNDVSSLLQV
RPPTRSSWKGGVEALEHALSMESDVTKSIRNVIKACEDDSEFNDYHLVDY
LTGDFLEEQYKGQRDLAGKASTLKKLMDRHEALGEFIFDKKLLGIDV
```

620345.c1-chim_201C-433C_5ln_iFerr-H-nt19
(SEQ ID NO: 37)
```
AENLWVTVYYGVPVWRDADTTLFCASDAKVHSTEVHNVWATHACVPTDPN
PQEIHLENVTENFNMWQNKMAEQMQEDVISLWDQSLKPCIKLTPLCVTLS
CTEAKFNETFNKIDNITKVSNLTDEMRNCSFNMTTELRDKKQQVYALFYK
LDIVPIDNSSEYRLINCNTSVCKQACPKVSFDPIPIHYCTPAGYAILKCN
DKNFNGTGPCKNVSSVQCTHGIKPVVSTHLLLNGSLAEEEIVIRSEDITK
NTKTIIVHLNKSVEINCTRPSNNTRTSVRIGPGQVFYRTGEVITSIRKAY
CEINGTKWNETLRQVAKKLKEHFKNKTIIFQPPSGGDLEVTTHHFNCRGE
FFYCDTAQLFNSTWRGNETKEERNGTSNDIIILPCRIKQIVRMWQGVGQC
MYAPPISGIINCVSNITGILLTSDGDGGPTADNETFRPAGGDMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggRSCRNSMRQQI
QMEVGASLQYLAMGAHFSKDVVNRPGFAQLFFDAASEEREHAMKLIEYLL
MRGELTNDVSSLLQVRPPTRSSWKGGVEALEHALSMESDVTKSIRNVIKA
CEDDSEFNDYHLVDYLTGDFLEEQYKGQRDLAGKASTLKKLMDRHEALGE
FIFDKKLLGIDV
```

6545.V4.C1-chim_201C-433C_5ln_iFerr-H-nt19
(SEQ ID NO: 38)
```
AENLWVTVYYGVPVWKDAETTLFCASDAKAYEREVHNVWATHACVPTDPN
PQEVIMENVTENFNMWKNNMVDQMHEDIISLWDQSLKPCVKLTPLCVTLD
CRNVSDTRNGNVTYNNTMNEEIKNCSFNMTTELRDKKQKVSALFYRIDIV
SLNSNSSDYRLINCNTSACTQACPKVSFEPIPIHYCAPAGYAILKCNNET
FNGTGPCHNVSTVQCTHGIKPVVSTQLLLNGSLAKEQVMIRSEDITNSVK
NIIVQFTEPVKINCTRPNNNTRKSVHIAPGQAFYATGDIIGNIRQAYCTV
NRTAWSNTLQKVVTRLRTYFGNKTIIFKNSSGGDIEITTHSFNCAGEFFY
CNTSSLFNSTWQVSGQGLNSTELGDTITLQCRIKQIINMWQRAGCIYAP
PIPGVIRCESNITGLILTSDYGNRSSDNETFRPTGGDMRDNWRSELYKYK
VVKIEPLGVAPTRCKRRVVGRRRRRRAVGIGAVFLGFLGAAGSTMGAASM
TLTVQARNLLSGIVQQQSNLLRAPEAQQHLLKLTVWGIKQLQARVLAVER
YLRDQQLLGIWGCSGKLICCTNVPWNSSWSNRNLSEIWDNMTWLQWDKEI
SNYTQIIYGLLEESQNQQEKNEQDLLALDggsggRSCRNSMRQQIQMEVG
ASLQYLAMGAHFSKDVVNRPGFAQLFFDAASEEREHAMKLIEYLLMRGEL
TNDVSSLLQVRPPTRSSWKGGVEALEHALSMESDVTKSIRNVIKACEDDS
```

-continued

EFNDYHLVDYLTGDFLEEQYKGQRDLAGKASTLKKLMDRHEALGEFIFDK

KLLGIDV

AC10.29-chim_201C-433C_5ln_iFerr-H-nt19
(SEQ ID NO: 39)
AENLWVTVYYGVPVWKEANTTLFCASDAKAYNTEVHNVWATHACVPTDPN

PQEVELENVTENFNMWKNNMVDQMHEDIISLWDQSLKPCVKLTPLCVTLS

CTDNVGNDTSTNNSRWDKMEKGEIKNCSFNITTNMRDKMQKQYALFYKLD

VVPIEEGKNNNSSFTDYRLISCNTSVCTQACPKVTFEPIPIHYCAPAGFA

LLKCKDKKFNGTGPCKNVSTVQCTHGIKPVVSTQLLLNGSLAEEEVVIRS

ENFSNNARTIIVQLNTSVEIKCIRPNNNTRKGIHIGPGRAFYTTGDIIGD

IRQAHCNISRQNWNNTLKQIAEKLREQFGNKTIVFRNSSGGDPEIVMHTF

NCAGEFFYCNTAELFNSTWYANGTISIGGGNKTNIILPCRIKQFINMWQE

VGKCMYAPPISGQIRCSSNITGLLLTRDGRGNQTDNQTEIFRPVGGDMK

NNWRSELYKYKVVKIEPLGVAPTRCKRRVVGRRRRRRAVGIGAVFLGFLG

AAGSTMGAASMTLTVQARNLLSGIVQQQSNLLRAPEAQQHLLKLTVWGIK

QLQARVLAVERYLRDQQLLGIWGCSGKLICCTNVPWNSSWSNRNLSEIWD

NMTWLQWDKEISNYTQIIYGLLEESQNQQEKNEQDLLALDggsggRSCRN

SMRQQIQMEVGASLQYLAMGAHFSKDVVNRPGFAQLFFDAASEEREHAMK

LIEYLLMRGELTNDVSSLLQVRPPTRSSWKGGVEALEHALSMESDVTKSI

RNVIKACEDDSEFNDYHLVDYLTGDFLEEQYKGQRDLAGKASTLKKLMDR

HEALGEFIFDKKLLGIDV

BI369.9A-chim_201C-433C_5ln_iFerr-H-nt19
(SEQ ID NO: 40)
AENLWVTVYYGVPVWRDADTTLFCASDAKAYETEKHNVWATHACVPTDPN

PQEIHLDNVTEKFNMWKNNMVEQMHTDIISLWDQSLKPCVKLTPLCVTLH

CTNFNPNSTRNGSNDTDRGEGGNNTVTNREEIKNCSFNMTTELRDRKRKV

HSLFYKLDIVQINKNQSQDNGSEYRLINCNTSACTQACPKVSFEPIPIHY

CAPAGFAILKCKDEEFNGTGPCKNVSTVQCTHGIKPVVSTQLLLNGSLAE

KEVKIRSENITNNVKTIIVQLVNPVIINCTRPNNNTRKSIRIGPGQSFYA

TDIIGDIRQAHCNVSRSDWNKTLQQVARQLRKHFVNKTIIFTNSSGGDLE

VTTHSFNCGGEFFYCSTSGLFNSTWDSSTWDSNSTQANITELNENITLPC

RIRQIINMWQRTGQCMYAPPIPGVISCVSNITGLLLTRDGGGNNNTNETF

RPGGGDMRDNWRSELYKYKVVKIEPLGVAPTRCKRRVVGRRRRRRAVGIG

AVFLGFLGAAGSTMGAASMTLTVQARNLLSGIVQQQSNLLRAPEAQQHLL

KLTVWGIKQLQARVLAVERYLRDQQLLGIWGCSGKLICCTNVPWNSSWSN

RNLSEIWDNMTWLQWDKEISNYTQIIYGLLEESQNQQEKNEQDLLALDgg sggRSCRNSMRQQIQMEVGASLQYLAMGAHFSKDVVNRPGFAQLFFDAAS

EEREHAMKLIEYLLMRGELTNDVSSLLQVRPPTRSSWKGGVEALEHALSM

ESDVTKSIRNVIKACEDDSEFNDYHLVDYLTGDFLEEQYKGQRDLAGKAS

TLKKLMDRHEALGEFIFDKKLLGIDV

C1080.c3-chim_201C-433C_5ln_iFerr-H-nt19
(SEQ ID NO: 41)
AENLWVTVYYGVPVWKDADTTLFCASDAKAHETEAHNIWATHACVPTDPN

PQEIYMENVTENFNMWKNNMVEQMQEDIISLWDQSLKPCVKLTHLCVTLS

CTNVTLTNVNYTNNFPNIGNITDEVRNCSFNVTTEIRDKKQKVYALFYKT

DIVQMENKNSYRLINCNTSVCKQACPKISFDPIPIHYCTPAGYAILKCNE

KNFNGTGPCKNVSSVQCTHGIKPVVSTQLLLNGSLAEGEIIIRSENLTNN

AKTIIVHLNKSVEINCTRPSNNTRTSVTIGPGQVFYRTGDIIGDIRKAYC

EINGTKWNETLKQVVGKLKEHFPNKKISFQPPSGGDLEITMHHFNCRGEF

FYCNTTQLFNSTWINSTGIKEYNDTIIYLPCKIKQIINMWQGVGQCMYAP

PIRGKINCVSNITGILLTRDGGDANATNDTETFRPGGGNIKDNWRSELYK

YKVVKIEPLGVAPTRCKRRVVGRRRRRRAVGIGAVFLGFLGAAGSTMGAA

SMTLTVQARNLLSGIVQQQSNLLRAPEAQQHLLKLTVWGIKQLQARVLAV

ERYLRDQQLLGIWGCSGKLICCTNVPWNSSWSNRNLSEIWDNMTWLQWDK

EISNYTQIIYGLLEESQNQQEKNEQDLLALDggsggRSCRNSMRQQIQME

VGASLQYLAMGAHFSKDVVNRPGFAQLFFDAASEEREHAMKLIEYLLMRG

ELTNDVSSLLQVRPPTRSSWKGGVEALEHALSMESDVTKSIRNVIKACED

DSEFNDYHLVDYLTGDFLEEQYKGQRDLAGKASTLKKLMDRHEALGEFIF

DKKLLGIDV

C4118.09-chim_201C-433C_5ln_iFerr-H-nt19
(SEQ ID NO: 42)
AENLWVTVYYGVPVWRDADTTLFCASDAKAQETEAHNIWATHACVPTDPN

PQEIHLENVTENFNMWKNNMVEQMQEDVISLWDQSLKPCVKLTPLCVTLN

CTTAKVINATIPANVSNIMGNITDEVRNCSFNMTTELRDRKQKAYALFYK

LDIVQIKDNKNSSSEYRLINCNTSVCKQACPKVSFDPIPIHYCTPAGYAL

LKCNDKNFNGTGPCNNVSSVQCTHGIKPVVSTQLLLNGSLAEEEIIISSE

NLTNNAKTIIVHLNKSVEINCTRPSVNTRTSMHIGPGQVLYRTGDIIGDI

RNAYCEIDGTKWSEALELVTEKLKKHFSEIKFQPPSGGDLEITMHHFNCK

GEFFYCNTSQLFNNNHKECNGTITLPCRIKQIINMWQGAGQCMYAPPISG

KINCVSNITGILLTRDGGTNNNTNSSETFRPGGGNIKDNWRSELYKYKVV

KIEPLGVAPTRCKRRVVGRRRRRRAVGIGAVFLGFLGAAGSTMGAASMTL

TVQARNLLSGIVQQQSNLLRAPEAQQHLLKLTVWGIKQLQARVLAVERYL

RDQQLLGIWGCSGKLICCTNVPWNSSWSNRNLSEIWDNMTWLQWDKEISN

YTQIIYGLLEESQNQQEKNEQDLLALDggsggRSCRNSMRQQIQMEVGAS

LQYLAMGAHFSKDVVNRPGFAQLFFDAASEEREHAMKLIEYLLMRGELTN

DVSSLLQVRPPTRSSWKGGVEALEHALSMESDVTKSIRNVIKACEDDSEF

NDYHLVDYLTGDFLEEQYKGQRDLAGKASTLKKLMDRHEALGEFIFDKKL

LGIDV

CAP45.G3-chim_201C-433C_5ln_iFerr-H-nt19
(SEQ ID NO: 43)
AENLWVTVYYGVPVWKEAKATLFCASDARAYEKEVHNVWATHACVPTDPN

PQEIYLGNVTENFNMWKNDMVDQMHEDIISLWDQSLKPCVKLTPLCVTLR

CTNATINGSLTEEVKNCSFNITTELRDKKQKAYALFYRPDVVPLNKNSPS

GNSSEYILINCNTSTCTQACPKVSFDPIPIHYCAPAGYAILKCNNKTFNG

TGPCNNVSTVQCTHGIKPVVSTQLLLNGSLAEEDIIIKSENLTNNIKTII

VHLNKSVEIVCRRPNNNTRKSIRIGPGQAFYATNDIIGDIRQAHCNINNS

-continued

TWNRTLEQIKKKLREHFLNRTIEFEPPSGGDLEVTTHSFNCGGEFFYCNT
TRLFKWSSNVTNDTITIPCRIKQFINMWQGAGRCMYAPPIEGNITCNSSI
TGLLLTRDGGKTDRNDTEIFRPGGGNMKDNWRSELYKYKVVKIEPLGVAP
TRCKRRVVGRRRRRAVGIGAVFLGFLGAAGSTMGAASMTLTVQARNLLS
GIVQQQSNLLRAPEAQQHLLKLTVWGIKQLQARVLAVERYLRDQQLLGIW
GCSGKLICCTNVPWNSSWSNRNLSEIWDNMTWLQWDKEISNYTQIIYGLL
EESQNQQEKNEQDLLALDggsggRSCRNSMRQQIQMEVGASLQYLAMGAH
FSKDVVNRPGFAQLFFDAASEEREHAMKLIEYLLMRGELTNDVSSLLQVR
PPTRSSWKGGVEALEHALSMESDVTKSIRNVIKACEDDSEFNDYHLVDYL
TGDFLEEQYKGQRDLAGKASTLKKLMDRHEALGEFIFDKKLLGIDV CH038.12-chim_201C-433C_5ln_iFerr-H-nt19
(SEQ ID NO: 44)
AENLWVTVYYGVPVWREANTTLFCASDAKAYDTEVHNVWATHACVPTDPK
PQEVFLKNVTENFNMWKNEMVNQMHEDVISLWEQSLKPCVKLTPLCVTLK
CNDVNSTSNGTSNGTDHKNMNEMKNCSFNTTTELRDRKKSEYALFYRLDI
VPLDENSNEYILINCNTSACTQACPKVTFDPIPIHYCAPAGYAILKCNDT
KFNGTGPCHNVSTVQCTHGIKPVVSTQLLLNGSLAEEEIMIRSENLTDNA
KIIIVHLNQSVEINCTRPGNNTRRSIRIGPGQTFYATGDIIGDIRKAHCN
ISRERWNETVQRVVKKLAEHFPNKTIKFESSSGGDLEITTHSFNCGGEFF
YCNTSGLFNGTYMPNGTKINDTERNLSSTITIPCRIKQIINMWQGVGQCM
YAPPIKGNIACKSNITGLLLTRDGGRSNETNDTETFRPEGGNMKDNWRSE
LYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggRSCRNSMRQQI
QMEVGASLQYLAMGAHFSKDVVNRPGFAQLFFDAASEEREHAMKLIEYLL
MRGELTNDVSSLLQVRPPTRSSWKGGVEALEHALSMESDVTKSIRNVIKA
CEDDSEFNDYHLVDYLTGDFLEEQYKGQRDLAGKASTLKKLMDRHEALGE
FIFDKKLLGIDV CH117.4-chim_201C-433C_5ln_iFerr-H-nt19
(SEQ ID NO: 45)
AENLWVTVYYGVPVWKEATTTLFCASDAKAYDTEVHNVWATHACVPTDPN
PQEMVLENVTENFNMWKNEMINQMHEDVVSLWDQSLKPCVKLTPLCVTLK
CRNVSDSRNGNSTYNESEQEMKNCSFNVTTILRDKKKKVDALFYKLDIVP
LHKKKNSKNNSIEYYRLINCNTSACTQACPKVTFDPIPIHYCTPAGYAIL
KCNDKTFNGTGPCHNVSTVQCTHGIKPVVSTQLLLNGSLAEGEIIIRSEN
LTDNVKTIIVHLNKSVEIVCTRPNNNTRKSIRIGPGQTFYATDIIGDIRQ
AYCNINRTMWTQTLQRVSEKLAEHFPNKTINFTSSSGGDLEIATHSFNCR
GEFFYCNTSGLFNSTYMPNGTYMHSGAESNSSLITIPCRIKQIINMWQEV
GQCMYAPPIAGNITCSSNITGLLLERDGGRDINNTEIFRPGGGDMKNNWR
SELYKYKVVKIEPLGVAPTRCKRRVVGRRRRRAVGIGAVFLGFLGAAGS
TMGAASMTLTVQARNLLSGIVQQQSNLLRAPEAQQHLLKLTVWGIKQLQA
RVLAVERYLRDQQLLGIWGCSGKLICCTNVPWNSSWSNRNLSEIWDNMTW -continued LQWDKEISNYTQIIYGLLEESQNQQEKNEQDLLALDggsggRSCRNSMRQ
QIQMEVGASLQYLAMGAHFSKDVVNRPGFAQLFFDAASEEREHAMKLIEY
LLMRGELTNDVSSLLQVRPPTRSSWKGGVEALEHALSMESDVTKSIRNVI
KACEDDSEFNDYHLVDYLTGDFLEEQYKGQRDLAGKASTLKKLMDRHEAL
GEFIFDKKLLGIDV MB201.A1-chim_201C-433C_5ln_iFerr-H-nt19
(SEQ ID NO: 46)
AENLWVTVYYGVPVWRDADTTLFCASDAKAYETEKHNVWATHACVPTDPN
PQEIHLDNVTEKFNMWKNNMVEQMHTDIISLWDQSLKPCVKLTPLCVTLE
CRNITGVNITEGKEEIKNCSFNITTELRDKWQKVYSLFYRLDVVQIDEGD
KNSTQYRLINCNTSACTQACPKVTFEPIPIHYCAPAGFAILKCNDKEFNG
TGPCKNVSTVQCTHGIRPVISTQLLLNGSLAEKEVRIRSENITNNAKTII
VQFTESVKINCTRPGNNTRKSIRIGPGQTFYARGDIIGDIRQAYCKVNRS
EWNKTLQKVAKQLGKYFGNKTVIFNSSSGGDLEITTHSFNCGGEFFYCNT
SGLFNSTWTWNTSTWNQVNSTESNDTIILQCRIKQIINMWQRTGQCIYAP
PIQGEIRCVSNITGLLLTRDGGNNNGTSETFRPEGGNMRDNWRSELYKYK
VVKIEPLGVAPTRCKRRVVGRRRRRAVGIGAVFLGFLGAAGSTMGAASM
TLTVQARNLLSGIVQQQSNLLRAPEAQQHLLKLTVWGIKQLQARVLAVER
YLRDQQLLGIWGCSGKLICCTNVPWNSSWSNRNLSEIWDNMTWLQWDKEI
SNYTQIIYGLLEESQNQQEKNEQDLLALDggsggRSCRNSMRQQIQMEVG
ASLQYLAMGAHFSKDVVNRPGFAQLFFDAASEEREHAMKLIEYLLMRGEL
TNDVSSLLQVRPPTRSSWKGGVEALEHALSMESDVTKSIRNVIKACEDDS
EFNDYHLVDYLTGDFLEEQYKGQRDLAGKASTLKKLMDRHEALGEFIFDK
KLLGIDV MW965.26-chim_201C-433C_5ln_iFerr-H-nt19
(SEQ ID NO: 47)
AENLWVTVYYGVPVWKEAKTTLFCASEAKAYEKEVHNVWATHACVPTDPN
PQEMVLENVTENFNMWKNDMVNQMHEDIISLWDQSLKPCVKLTPLCVTLN
CTNANGTNNNGTVNVNDTMYGEIKNCSFNMTTELRDKKKQVYALFYKLDI
VSLNENSNNSSEYRLINCNTSVCTQACPKVTFDPIPIHYCAPAGYAILKC
NNKTFTGIGPCKNVSTVQCTHGIKPVVSTQLLLNGSLAEEEIIVRSENLT
DNVKTIIVHLNESVEIVCTRPNNNTRKSVRIGPGQTFYATGAIIGDIRQA
HCNISTIKWNKTLQGVEKKLKEHFPNKTIEFKPSSGGDLEITTHSFNCRG
EFFCCNTSNLFTSNLFTDNLTNTTNITLPCRIKQIINMWQGVGRCMYAPP
IAGNITCKSNITGLLLTRDGGENNRTETFRPGGGDMKDNWRSELYKYKVV
KIEPLGVAPTRCKRRVVGRRRRRAVGIGAVFLGFLGAAGSTMGAASMTL
TVQARNLLSGIVQQQSNLLRAPEAQQHLLKLTVWGIKQLQARVLAVERYL
RDQQLLGIWGCSGKLICCTNVPWNSSWSNRNLSEIWDNMTWLQWDKEISN
YTQIIYGLLEESQNQQEKNEQDLLALDggsggRSCRNSMRQQIQMEVGAS
LQYLAMGAHFSKDVVNRPGFAQLFFDAASEEREHAMKLIEYLLMRGELTN
DVSSLLQVRPPTRSSWKGGVEALEHALSMESDVTKSIRNVIKACEDDSEF

NDYHLVDYLTGDFLEEQYKGQRDLAGKASTLKKLMDRHEALGEFIFDKKL
LGIDV

QH209.14M.A2-chim_201C-433C_5ln_iFerr-H-nt19
(SEQ ID NO: 48)
AENLWVTVYYGVPVWKDAETTLFCASDAKAYDKEVHNVWATHACVPTDPN
PQEVHLENVTEEFNMWKNYMVEQMHTDIISLWDQSLQPCVKLTPLCVTLN
CSHNINHNETTFSNDTNLPNITEEMRNCSFNMTTEVRDRQKQVYSLFYRL
DIVQINEDQKEGSKGRYRLINCNTSACTQACPKVSFEPIPIHFCAPAGFA
ILKCKDKEFNGTGPCKNVSTVQCTHGIRPVVSTQLLLNGSLAEGKVMIRS
ENFTNNAKNIIVQFNESVEIECLRPNNNTRESIHLGPGRAFYARGGIIGD
IRQAHCIVNKTNWNKALKEVAKQLRTIFNKTIKFTNSSGGDIEITTHSFN
CRGEFFYCNTTGLFNLTWNGTDSTNRNESGNITLPCRIKQIINMWQRVGR
CIYAPPIPGVVKCKSNITGLILTRDGGDDENNTETFRPGGGNMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggRSCRNSMRQQI
QMEVGASLQYLAMGAHFSKDVVNRPGFAQLFFDAASEEREHAMKLIEYLL
MRGELTNDVSSLLQVRPPTRSSWKGGVEALEHALSMESDVTKSIRNVIKA
CEDDSEFNDYHLVDYLTGDFLEEQYKGQRDLAGKASTLKKLMDRHEALGE
FIFDKKLLGIDV TH966.8-chim_201C-433C_5ln_iFerr-H-nt19
(SEQ ID NO: 49)
AENLWVTVYYGVPVWRDADTTLFCASDAKAHETEVHNVWATHACVPTDPN
PQEIHLENITENFNMWKNNMVEQMQEDVISLWDQSLKPCVKLTPLCVTLN
CINANLTNVNNIIHGPNIIGNITDEVRNCSFNMTTEIRDKKQKVHALFYK
LDLVQIEDKNSSEYRLINCNTSVCKQACPKISFDPIPIHYCTPAGYAILK
CNDKNFNGTGPCTNVSSVQCTHGIKPVVSTQLLLNGSLAEEEIIRSENL
TNNAKTIIVHLNKSVEINCTRPSNNTRTSTTIGPGQVFYRTGDITGNIRK
AYCEINGTKWNEALKQVTKKLKEHFNNKTIIFQPPSSGGDLEITMHHFNCR
GEFFYCNTTRLFNNTCIGNETIGGCNDTIILPCKIKQIINMWQGAGLCMY
APPISGRINCVSNITGILLTRDGGANNTSNETFRPGGGNIKDNWRSELYK
YKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggsggRSCRNSMRQQIQME
VGASLQYLAMGAHFSKDVVNRPGFAQLFFDAASEEREHAMKLIEYLLMRG
ELTNDVSSLLQVRPPTRSSWKGGVEALEHALSMESDVTKSIRNVIKACED
DSEFNDYHLVDYLTGDFLEEQYKGQRDLAGKASTLKKLMDRHEALGEFIF
DKKLLGIDV ZM106.9-chim_201C-433C_5ln_iFerr-H-nt19
(SEQ ID NO: 50)
AENLWVTVYYGVPVWKEAKTTLFCASDAKAYEREVHNVWATHACVPTDPS
PQEMVLENVTENFNMWKNDMVDQMHEDIISLWDQSLKPCVKLTPLCVTLK
CVNVNATSKSNASATNDGSGEMKNCTFNITTEIRDKKRNESALFYKLDIV
PLTNDNNSGEYRLINCNTSACTQACPKVSFDPIPIHYCAPAGYAILKCNN
KTFNGTGPCYNVSTVQCTHGIKPVVSTQLLLNGSLAEGEIIIRSENLTDN
VKTIIVHLNESIHITCTRPNNNTRKSIRIGPGQTFYATGEIIGDIRKAYC
NISEEKWNKALQEVGKKLKEHFPNKTIKFAPSSGGDLEITTHSFNCRGEF
FYCNTSKLFNSTYMHNATSRNATNATITLPCRIRQIINMWQEVGRCMYAP
PIAGNITCVSNITGLLLVRDGGNGDTNDTETFRPGGGDMKNNWRSELYKY
KVVKIEPLGVAPTRCKRRVVGRRRRRRAVGIGAVFLGFLGAAGSTMGAAS
MTLTVQARNLLSGIVQQQSNLLRAPEAQQHLLKLTVWGIKQLQARVLAVE
RYLRDQQLLGIWGCSGKLICCTNVPWNSSWSNRNLSEIWDNMTWLQWDKE
ISNYTQIIYGLLEESQNQQEKNEQDLLALDggsggRSCRNSMRQQIQMEV
GASLQYLAMGAHFSKDVVNRPGFAQLFFDAASEEREHAMKLIEYLLMRGE
LTNDVSSLLQVRPPTRSSWKGGVEALEHALSMESDVTKSIRNVIKACEDD
SEFNDYHLVDYLTGDFLEEQYKGQRDLAGKASTLKKLMDRHEALGEFIFD
KKLLGIDV ZM55.28a-chim_201C-433C_5ln_iFerr-H-nt19
(SEQ ID NO: 51)
AENLWVTVYYGVPVWKEAKTTLFCASDAKAYEREVHNVWATHACVPTDPN
PQEMVLENVTENFNMWKNDMVDQMHEDIISLWDESLKPCVKLTPLCVTLN
CTFITNTTEIKNCTFNMTTELRDIKQQGRALFDTLDIVPLKPPNNSSNYS
EYRLISCNTSTCTQACPKVSFDPIPIHYCAPAGYAILKCNNKTFNGLGPC
NNVSTVQCTHGIKPVVSTQLLLNGSLAEEEIIRSENLTNNVKTIIVHLN
EPVYIVCTRPNNNTRKSMRIGPGQTFYATGDIIGDIRQAHCNISIEKWNT
TLEKVKERLKKHFPNKIIKFEPSSGGDLEITTHSFNCRGEFFYCNTANLF
NETFMNQTDANQTNATITLQCRIKQIINMWQGVGRCMYAPPIPGRITCNS
SITGLILTRDGGENTTDNGTEIFRPGGGDMRDNWRSELYKYKVVKIEPLG
VAPTRCKRRVVGRRRRRRAVGIGAVFLGFLGAAGSTMGAASMTLTVQARN
LLSGIVQQQSNLLRAPEAQQHLLKLTVWGIKQLQARVLAVERYLRDQQLL
GIWGCSGKLICCTNVPWNSSWSNRNLSEIWDNMTWLQWDKEISNYTQIIY
GLLEESQNQQEKNEQDLLALDggsggRSCRNSMRQQIQMEVGASLQYLAM
GAHFSKDVVNRPGFAQLFFDAASEEREHAMKLIEYLLMRGELTNDVSSLL
QVRPPTRSSWKGGVEALEHALSMESDVTKSIRNVIKACEDDSEFNDYHLV
DYLTGDFLEEQYKGQRDLAGKASTLKKLMDRHEALGEFIFDKKLLGIDV bg505.sosip_201C-433C_5ln_iFerr-H-nt19
(SEQ ID NO: 52)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAcTQACPKVSFEPIPIHYCAPAGFAILKCKD KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
cMYAPPIQGVIRCVSNITGLILTRDGGSTNSTTETFRPGGGDMRDNWRSE
LYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggRSCRNSMRQQI
QMEVGASLQYLAMGAHFSKDVVNRPGFAQLFFDAASEEREHAMKLIEYLL
MRGELTNDVSSLLQVRPPTRSSWKGGVEALEHALSMESDVTKSIRNVIKA
CEDDSEFNDYHLVDYLTGDFLEEQYKGQRDLAGKASTLKKLMDRHEALGE
FIFDKKLLGIDV bg505.sosip_5ln_iFerr-L-nt30
(SEQ ID NO: 53)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggEYGSHGNVATE
LQAYAKLHLERSYDYLLSAAYFNNYQTNRAGFSKLFKKLSDEAWSKTIDI
IKHVTKRGDKMNFDQHSTMKTERKNYTAENHELEALAKALDTQKELAERA
FYIHREATRNSQHLHDPEIAQYLEEEFIEDHAEKIRTLAGHTSDLKKFIT
ANNGHDLSLALYVFDEYLQKTV bg505.sosip_8ln_iFerr-L-nt30
(SEQ ID NO: 54)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggsgEYGSHGNV
ATELQAYAKLHLERSYDYLLSAAYFNNYQTNRAGFSKLFKKLSDEAWSKT
IDIIKHVTKRGDKMNFDQHSTMKTERKNYTAENHELEALAKALDTQKELA
ERAFYIHREATRNSQHLHDPEIAQYLEEEFIEDHAEKIRTLAGHTSDLKK
FITANNGHDLSLALYVFDEYLQKTV bg505.sosip_2ln_iFerr-H-nt19
(SEQ ID NO: 55)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggRSCRNSMRQQIQME
VGASLQYLAMGAHFSKDVVNRPGFAQLFFDAASEEREHAMKLIEYLLMRG
ELTNDVSSLLQVRPPTRSSWKGGVEALEHALSMESDVTKSIRNVIKACED
DSEFNDYHLVDYLTGDFLEEQYKGQRDLAGKASTLKKLMDRHEALGEFIF
DKKLLGIDV bg505.sosip_5ln_iFerr-H-nt19
(SEQ ID NO: 56)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALDggsggRSCRNSMRQQI

```
QMEVGASLQYLAMGAHFSKDVVNRPGFAQLFFDAASEEREHAMKLIEYLL
MRGELTNDVSSLLQVRPPTRSSWKGGVEALEHALSMESDVTKSIRNVIKA
CEDDSEFNDYHLVDYLTGDFLEEQYKGQRDLAGKASTLKKLMDRHEALGE
FIFDKKLLGIDV

ZM53-chim_ds201-433_iFerr-H-nt19_5ln
                                         (SEQ ID NO: 57)
AENLWVTVYYGVPVWREAKTTLFCASDAKAYEREVHNVWATHACVPTDPN
PQEMVLENVTENFNMWKNDMVDQMQEDIISLWDQSLKPCVKLTPLCVTLN
CSKLNNATDGEMKNCSFNATTELRDKKKQVYALFYKLDIVPLDGRNNSSE
YRLINCNTSTCTQACPKVSFDPIPIHYCAPAGYAILKCNNKTFNGTGPCH
NVSTVQCTHGIKPVISTQLLLNGSTAEEDIIIRSENLTNNAKTIIVHLNE
SIEIECTRPGNNTRKSIRIGPGQAFFATTNIIGDIRQAYCIINKANWTNT
LHRVSKKLEEHFPNKTINFNSSSGGDLEITTHSFNCGGEFFYCNTSSLFN
GTYNDTDIYNSTDIILLCRIKQIINMWQEVGRCMYAPPIEGNITCSSNIT
GLLLTRDGGLTNESKETFRPGGGDMRDNWRSELYKYKVVKIEPLGVAPTR
CKRRVVGRRRRRAVGIGAVFLGFLGAAGSTMGAASMTLTVQARNLLSGI
VQQQSNLLRAPEAQQHLLKLTVWGIKQLQARVLAVERYLRDQQLLGIWGC
SGKLICCTNVPWNSSWSNRNLSEIWDNMTWLQWDKEISNYTQIIYGLLEE
SQNQQEKNEQDLLALDggsggRSCRNSMRQQIQMEVGASLQYLAMGAHFS
KDVVNRPGFAQLFFDAASEEREHAMKLIEYLLMRGELTNDVSSLLQVRPP
TRSSWKGGVEALEHALSMESDVTKSIRNVIKACEDDSEFNDYHLVDYLTG
DFLEEQYKGQRDLAGKASTLKKLMDRHEALGEFIFDKKLLGIDV CNE55-glyc332-chim_ds201-433_iFerr-H-nt19_5ln
                                         (SEQ ID NO: 58)
AENLWVTVYYGVPVWRDADTTLFCASDAKAHETEVHNVWATHACVPTDPN
PQEIHLVNVTENFNMWKNKMVEQMQEDVISLWDESLKPCVKLTPLCVTLN
CTTANTNETKNNTTDDNIKDEMKNCTFNMTTEIRDKKQRVSALFYKLDIV
PIDDSKNNSEYRLINCNTSVCKQACPKVSFDPIPIHYCTPAGYVILKCND
KNFNGTGPCKNVSSVQCTHGIKPVVSTQLLLNGSLAEEEIIIRSENLTDN
AKNIIVHLNKSVEINCTRPSNNTRTSVRIGPGQVFYRTGDITGDIRKAYC
NISGTEWNKTLTQVAEKLKEHFNKTIVYQPPSGGDLEITMHHFNCRGEFF
YCNTTQLFNNSVGNSTIKLPCRIKQIINMWQGVGQCMYAPPISGAINCLS
NITGILLTRDGGGNNRSNETFRPGGGNIKDNWRSELYKYKVVKIEPLGVA
PTRCKRRVVGRRRRRAVGIGAVFLGFLGAAGSTMGAASMTLTVQARNLL
SGIVQQQSNLLRAPEAQQHLLKLTVWGIKQLQARVLAVERYLRDQQLLGI
WGCSGKLICCTNVPWNSSWSNRNLSEIWDNMTWLQWDKEISNYTQIIYGL
LEESQNQQEKNEQDLLALDggsggRSCRNSMRQQIQMEVGASLQYLAMGA
HFSKDVVNRPGFAQLFFDAASEEREHAMKLIEYLLMRGELTNDVSSLLQV
RPPTRSSWKGGVEALEHALSMESDVTKSIRNVIKACEDDSEFNDYHLVDY
LTGDFLEEQYKGQRDLAGKASTLKKLMDRHEALGEFIFDKKLLGIDV P0402-chim_ds201-433_iFerr-H-nt19_5ln
                                         (SEQ ID NO: 59)
AENLWVTVYYGVPVWEDADTPLFCASDAKAYSTESHNVWATHACVPTDPS
PQEISLDNVTENFNMWKNNMVEQMHEDISLWDESLKPCVKLTPLCVTLN
CTNVNNSSATNNSMVDDREGLKNCSFNITTELRDKKKQEHALFYRLDIVP
INGNSNSNSSVGDYRLINCNVSTCKQACPKMSFDPIPIHYCAPAGFAILK
CRDKKFNGTGSCKNVSTVQCTHGIKPVISTQLLLNGSVAEEEIMIRSENF
TNNAKNIIVQFNKTIDIMCTRPNNNTRKSISLGPGQAIYATGDIIGNIRQ
AHCNISGADWGNMIRNVSEKLKEIFNKTTITFKASAGGDLEITTHSFNCR
GEFFYCDTSDLFNSSRFNNSSNDTNDTITLPCKIKQIVRMWQRVGQCMYA
PPIAGNITCRSNITGLLLTRDGGGNNTNETETFRPAGGDMRDNWRSELYK
YKVVKIEPLGVAPTRCKRRVVGRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggsggRSCRNSMRQQIQME
VGASLQYLAMGAHFSKDVVNRPGFAQLFFDAASEEREHAMKLIEYLLMRG
ELTNDVSSLLQVRPPTRSSWKGGVEALEHALSMESDVTKSIRNVIKACED
DSEFNDYHLVDYLTGDFLEEQYKGQRDLAGKASTLKKLMDRHEALGEFIF
DKKLLGIDV X1193-chim_ds201-433_iFerr-H-nt19_5ln
                                         (SEQ ID NO: 60)
AENLWVTVYYGVPVWEDADTTLFCASDAKAYSTESHNVWATHACVPTDPN
PQEIPLKNVTENFNMWKNNMVEQMHEDIISLWDESLKPCVKLTPLCVTLI
CTNVTSNSTNSTNGVTNNSTVDYREQLKNCSFNITTEIRDKQRKEYALFY
RLDIVPINDNEKNDTYRLINCNVSTCKQACPKVTFDPIPIHYCAPAGFAI
LKCRDKKFNGTGPCKNVSTVQCTHGIKPVISTQLLLNGSLAEGDIMIRSE
NITDNAKTIIVQLKTAVNITCTRPSNNTRKSIRFGPGQAFYATDEIIGDI
RQAHCNISKTEWEDMKRNVSDKLKALFNNKTIIFKSSSGGDLEITTHSFN
CRGEFFYCNTSGLFNTSGLFNNNSNDSSGNITLPCKIKQIVRMWQRVGQC
MYAPPIAGNITCRSRITGLLLVRDGGKSNETNGTETFRPAGGDMRDNWRS
ELYKYKVVKIEPLGVAPTRCKRRVVGRRRRRAVGIGAVFLGFLGAAGST
MGAASMTLTVQARNLLSGIVQQQSNLLRAPEAQQHLLKLTVWGIKQLQAR
VLAVERYLRDQQLLGIWGCSGKLICCTNVPWNSSWSNRNLSEIWDNMTWL
QWDKEISNYTQIIYGLLEESQNQQEKNEQDLLALDggsggRSCRNSMRQQ
IQMEVGASLQYLAMGAHFSKDVVNRPGFAQLFFDAASEEREHAMKLIEYL
LMRGELTNDVSSLLQVRPPTRSSWKGGVEALEHALSMESDVTKSIRNVIK
ACEDDSEFNDYHLVDYLTGDFLEEQYKGQRDLAGKASTLKKLMDRHEALG
EFIFDKKLLGIDV DU156.12-chim_ds201-433_iFerr-H-nt19_5ln
                                         (SEQ ID NO: 61)
AENLWVTVYYGVPVWTEAKTTLFCASDAKAYEKEVHNVWATHACVPTDPN
PQEIFLKNVTENFNMWKNDMVDQMHEDIISLWDQSLKPCVKLTPLCVTLN
CVTYNNSMNSSATYNNSMNGEIKNCSFNTTTELRDKKQKVYALFYRTDVV
PLNNNNNNSEYILINCNTSTCTQACPKVSFDPIPIHYCAPAGYAILKCTD
KKFNGTGSCNNVSTVQCTHGIKPVVSTQLLLNGSLAEEEIIIKSENLTDN
IKTIIVQLNQSIGINCTRPNNNTRKSVRIGPGQTFYATGDIIGDIRQAHC
```

NISRNQWNETLEQVKKKLGEHFHNQTKIKFEPPSGGDLEITTHSFNCRGE
FFYCNTADLFTNATKLVNDTENKAVITIPCRIKQIINMWQGVGRCMYAPP
IEGNITCNSNITGLLLTRDGGGNVTEINRTEIFRPGGGNMKDNWRSELYK
YKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggsggRSCRNSMRQQIQME
VGASLQYLAMGAHFSKDVVNRPGFAQLFFDAASEEREHAMKLIEYLLMRG
ELTNDVSSLLQVRPPTRSSWKGGVEALEHALSMESDVTKSIRNVIKACED
DSEFNDYHLVDYLTGDFLEEQYKGQRDLAGKASTLKKLMDRHEALGEFIF
DKKLLGIDV DU422.01-chim_ds201-433_iFerr-H-nt19_51n
(SEQ ID NO: 62)
AENLWVTVYYGVPVWKEAKTTLFCASDAKAYDKEVHNVWATHACVPTDPN
PQEIVLENVTENFNMWKNDMVDQMHEDIISLWDQSLKPCVKLTPLCVTLN
CKNVNISANANATATLNSSMNGEIKNCSFNTTTELRDKKQKVYALFYKPD
VVPLNGGEHNETGEYILINCNSSTCTQACPKVSFDPIPIHYCAPAGYAIL
KCNNKTFNGTGPCNNVSTVQCTHGIKPVVSTQLLLNGSLAEEEIIVRSEN
LTNNIKTIIVHLNKSVEIKCTRPNNNTRKSVRIGPGQTFYATGEIIGDIR
EAHCNISRETWNSTLIQVKEKLREHYNKTIKFEPSSGGDLEVTTHSFNCR
GEFFYCDTTKLFNETKLFNESEYVDNKTIILPCRIKQIINMWQEVGRCMY
APPIEGNITCKSNITGLLLTWDGGENSTEGVFRPGGGNMKDNWRSELYKY
KVVKIEPLGVAPTRCKRRVVGRRRRRRAVGIGAVFLGFLGAAGSTMGAAS
MTLTVQARNLLSGIVQQQSNLLRAPEAQQHLLKLTVWGIKQLQARVLAVE
RYLRDQQLGIWGCSGKLICCTNVPWNSSWSNRNLSEIWDNMTWLQWDKE
ISNYTQIIYGLLEESQNQQEKNEQDLLALDggsggRSCRNSMRQQIQMEV
GASLQYLAMGAHFSKDVVNRPGFAQLFFDAASEEREHAMKLIEYLLMRGE
LTNDVSSLLQVRPPTRSSWKGGVEALEHALSMESDVTKSIRNVIKACEDD
SEFNDYHLVDYLTGDFLEEQYKGQRDLAGKASTLKKLMDRHEALGEFIFD
KKLLGIDV 25925-chim_ds201-433_iFerr-H-nt19_51n
(SEQ ID NO: 63)
AENLWVTVYYGVPVWKEAKATLFCASDAKAYETEVHNVWATHACVPTDPN
PQEIVLENVTENFNMWENDMVNQMHEDVISLWDQSLKPCVKLTPLCVTLD
CENVDGNDTYNGTNEMKNCSFNTTTELRDKKQKVSALFYRLDIVPLNRSS
SSNSSDYYRLISCNTSACTQACPKVTFDPIPIHYCAPAGFAILKCNNKTF
NGTGPCHNVSTVQCTHGIKPVVSTQLLLNGSLAEKEIIIRSKNLSDNVKT
IIVHLNESVEIVCTRPNNNTRKSIRIGPGQTFYATGAIIGNIREAHCNIS
RDKWNETLQRVGKKLEEQFPNKTINFTSSSGGDLEITTHSFNCRGEFFYC
NTSKLFNSTYIPTYRPNNTQGNSSSTITIPCRIKQIINMWQEVGRCMYAP
PIAGNITCKSHITGLLLVRDGGTGLNSSTETFRPGGGDMRDNWRSELYKY
KVVKIEPLGVAPTRCKRRVVGRRRRRRAVGIGAVFLGFLGAAGSTMGAAS
MTLTVQARNLLSGIVQQQSNLLRAPEAQQHLLKLTVWGIKQLQARVLAVE
RYLRDQQLLGIWGCSGKLICCTNVPWNSSWSNRNLSEIWDNMTWLQWDKE
ISNYTQIIYGLLEESQNQQEKNEQDLLALDggsggRSCRNSMRQQIQMEV
GASLQYLAMGAHFSKDVVNRPGFAQLFFDAASEEREHAMKLIEYLLMRGE
LTNDVSSLLQVRPPTRSSWKGGVEALEHALSMESDVTKSIRNVIKACEDD
SEFNDYHLVDYLTGDFLEEQYKGQRDLAGKASTLKKLMDRHEALGEFIFD
KKLLGIDV ZM53-chim_ds201-433_iFerr-L-nt30_81n
(SEQ ID NO: 64)
AENLWVTVYYGVPVWREAKTTLFCASDAKAYEREVHNVWATHACVPTDPN
PQEMVLENVTENFNMWKNDMVDQMQEDIISLWDQSLKPCVKLTPLCVTLN
CSKLNNATDGEMKNCSFNATTELRDKKKQVYALFYKLDIVPLDGRNNSSE
YRLINCNTSTCTQACPKVSFDPIPIHYCAPAGYAILKCNNKTFNGTGPCH
NVSTVQCTHGIKPVISTQLLLNGSTAEEDIIRSENLTNNAKTIIVHLNE
SIEIECTRPGNNTRKSIRIGPGQAFFATTNIIGDIRQAYCIINKANWTNT
LHRVSKKLEEHFPNKTINFNSSSGGDLEITTHSFNCGGEFFYCNTSSLFN
GTYNDTDIYNSTDIILLCRIKQIINMWQEVGRCMYAPPIEGNITCSSNIT
GLLLTRDGGLTNESKETFRPGGGDMRDNWRSELYKYKVVKIEPLGVAPTR
CKRRVVGRRRRRRAVGIGAVFLGFLGAAGSTMGAASMTLTVQARNLLSGI
VQQQSNLLRAPEAQQHLLKLTVWGIKQLQARVLAVERYLRDQQLLGIWGC
SGKLICCTNVPWNSSWSNRNLSEIWDNMTWLQWDKEISNYTQIIYGLLEE
SQNQQEKNEQDLLALDggsgggsgEYGSHGNVATELQAYAKLHLERSYDY
LLSAAYFNNYQTNRAGFSKLFKKLSDEAWSKTIDIIKHVTKRGDKMNFDQ
HSTMKTERKNYTAENHELEALAKALDTQKELAERAFYIHREATRNSQHLH
DPEIAQYLEEEFIEDHAEKIRTLAGHTSDLKKFITANNGHDLSLALYVFD
EYLQKTV CNE55-glyc332-chim_ds201-433_iFerr-L-nt30_81n
(SEQ ID NO: 65)
AENLWVTVYYGVPVWRDADTTLFCASDAKAHETEVHNVWATHACVPTDPN
PQEIHLVNVTENFNMWKNKMVEQMQEDVISLWDESLKPCVKLTPLCVTLN
CTTANTNETKNNTTDDNIKDEMKNCTFNMTTEIRDKKQRVSALFYKLDIV
PIDDSKNNSEYRLINCNTSVCKQACPKVSFDPIPIHYCTPAGYVILKCND
KNFNGTGPCKNVSSVQCTHGIKPVVSTQLLLNGSLAEEEIIIRSENLTDN
AKNIIVHLNKSVEINCTRPSNNTRTSVRIGPGQVFYRTGDITGDIRKAYC
NISGTEWNKTLTQVAEKLKEHFNKTIVYQPPSSGGDLEITMHHFNCRGEFF
YCNTTQLFNNSVGNSTIKLPCRIKQIINMWQGVGQCMYAPPISGAINCLS
NITGILLTRDGGGNNRSNETFRPGGGNIKDNWRSELYKYKVVKIEPLGVA
PTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLGI
WGCSGKLICCTNVPWNSSWSNRNLSEIWDNMTWLQWDKEISNYTQIIYGL
LEESQNQQEKNEQDLLALDggsgggsgEYGSHGNVATELQAYAKLHLERS
YDYLLSAAYFNNYQTNRAGFSKLFKKLSDEAWSKTIDIIKHVTKRGDKMN
FDQHSTMKTERKNYTAENHELEALAKALDTQKELAERAFYIHREATRNSQ

```
HLHDPEIAQYLEEEFIEDHAEKIRTLAGHTSDLKKFITANNGHDLSLALY
VFDEYLQKTV

P0402-chim_ds201-433_iFerr-L-nt30_8ln
                                            (SEQ ID NO: 66)
AENLWVTVYYGVPVWEDADTPLFCASDAKAYSTESHNVWATHACVPTDPS

PQEISLDNVTENFNMWKNNMVEQMHEDIISLWDESLKPCVKLTPLCVTLN

CTNVNNSSATNNSMVDDREGLKNCSFNITTELRDKKKQEHALFYRLDIVP

INGNSNSNSSVGDYRLINCNVSTCKQACPKMSFDPIPIHYCAPAGFAILK

CRDKKFNGTGSCKNVSTVQCTHGIKPVISTQLLLNGSVAEEEIMIRSENF

TNNAKNIIVQFNKTIDIMCTRPNNNTRKSISLGPGQAIYATGDIIGNIRQ

AHCNISGADWGNMIRNVSEKLKEIFNKTTITFKASAGGDLEITTHSFNCR

GEFFYCDTSDLFNSSRFNNSSNDTNDTITLPCKIKQIVRMWQRVGQCMYA

PPIAGNITCRSNITGLLLTRDGGGNNTNETETFRPAGGDMRDNWRSELYK

YKVVKIEPLGVAPTRCKRRVVGRRRRRRAVGIGAVFLGFLGAAGSTMGAA

SMTLTVQARNLLSGIVQQQSNLLRAPEAQQHLLKLTVWGIKQLQARVLAV

ERYLRDQQLLGIWGCSGKLICCTNVPWNSSWSNRNLSEIWDNMTWLQWDK

EISNYTQIIYGLLEESQNQQEKNEQDLLALDggsgggsgEYGSHGNVATE

LQAYAKLHLERSYDYLLSAAYFNNYQTNRAGFSKLFKKLSDEAWSKTIDI

IKHVTKRGDKMNFDQHSTMKTERKNYTAENHELEALAKALDTQKELAERA

FYIHREATRNSQHLHDPEIAQYLEEEFIEDHAEKIRTLAGHTSDLKKFIT

ANNGHDLSLALYVFDEYLQKTV

X1193-chim_ds201-433_iFerr-L-nt30_8ln
                                            (SEQ ID NO: 67)
AENLWVTVYYGVPVWEDADTTLFCASDAKAYSTESHNVWATHACVPTDPN

PQEIPLKNVTENFNMWKNNMVEQMHEDIISLWDESLKPCVKLTPLCVTLI

CTNVTSNSTNSTNGVTNNSTVDYREQLKNCSFNITTEIRDKQRKEYALFY

RLDIVPINDNEKNDTYRLINCNVSTCKQACPKVTFDPIPIHYCAPAGFAI

LKCRDKKFNGTGPCKNVSTVQCTHGIKPVISTQLLLNGSLAEGDIMIRSE

NITDNAKTIIVQLKTAVNITCTRPSNNTRKSIRFGPGQAFYATDEIIGDI

RQAHCNISKTEWEDMKRNVSDKLKALFNNKTIIFKSSSGGDLEITTHSFN

CRGEFFYCNTSGLFNTSGLFNNNSNDSSGNITLPCKIKQIVRMWQRVGQC

MYAPPIAGNITCRSRITGLLLVRDGGKSNETNGTETFRPAGGDMRDNWRS

ELYKYKVVKIEPLGVAPTRCKRRVVGRRRRRRAVGIGAVFLGFLGAAGST

MGAASMTLTVQARNLLSGIVQQQSNLLRAPEAQQHLLKLTVWGIKQLQAR

VLAVERYLRDQQLLGIWGCSGKLICCTNVPWNSSWSNRNLSEIWDNMTWL

QWDKEISNYTQIIYGLLEESQNQQEKNEQDLLALDggsgggsgEYGSHGN

VATELQAYAKLHLERSYDYLLSAAYFNNYQTNRAGFSKLFKKLSDEAWSK

TIDIIKHVTKRGDKMNFDQHSTMKTERKNYTAENHELEALAKALDTQKEL

AERAFYIHREATRNSQHLHDPEIAQYLEEEFIEDHAEKIRTLAGHTSDLK

KFITANNGHDLSLALYVFDEYLQKTV

DU156.12-chim_ds201-433_iFerr-L-nt30_8ln
                                            (SEQ ID NO: 68)
AENLWVTVYYGVPVWTEAKTTLFCASDAKAYEKEVHNVWATHACVPTDPN

PQEIFLKNVTENFNMWKNDMVDQMHEDIISLWDQSLKPCVKLTPLCVTLN

CVTYNNSMNSSATYNNSMNGEIKNCSFNTTTELRDKKQKVYALFYRTDVV

PLNNNNNNSEYILINCNTSTCTQACPKVSFDPIPIHYCAPAGYAILKCTD

KKFNGTGSCNNVSTVQCTHGIKPVVSTQLLLNGSLAEEEIIIKSENLTDN

IKTIIVQLNQSIGINCTRPNNNTRKSVRIGPGQTFYATGDIIGDIRQAHC

NISRNQWNETLEQVKKKLGEHFHNQTKIKFEPPSGGDLEITTHSFNCRGE

FFYCNTADLFTNATKLVNDTENKAVITIPCRIKQIINMWQGVGRCMYAPP

IEGNITCNSNITGLLLTRDGGGNVTEINRTEIFRPGGGNMKDNWRSELYK

YKVVKIEPLGVAPTRCKRRVVGRRRRRRAVGIGAVFLGFLGAAGSTMGAA

SMTLTVQARNLLSGIVQQQSNLLRAPEAQQHLLKLTVWGIKQLQARVLAV

ERYLRDQQLLGIWGCSGKLICCTNVPWNSSWSNRNLSEIWDNMTWLQWDK

EISNYTQIIYGLLEESQNQQEKNEQDLLALDggsgggsgEYGSHGNVATE

LQAYAKLHLERSYDYLLSAAYFNNYQTNRAGFSKLFKKLSDEAWSKTIDI

IKHVTKRGDKMNFDQHSTMKTERKNYTAENHELEALAKALDTQKELAERA

FYIHREATRNSQHLHDPEIAQYLEEEFIEDHAEKIRTLAGHTSDLKKFIT

ANNGHDLSLALYVFDEYLQKTV

DU422.01-chim_ds201-433_iFerr-L-nt30_8ln
                                            (SEQ ID NO: 69)
AENLWVTVYYGVPVWKEAKTTLFCASDAKAYDKEVHNVWATHACVPTDPN

PQEIVLENVTENFNMWKNDMVDQMHEDIISLWDQSLKPCVKLTPLCVTLN

CKNVNISANANATATLNSSMNGEIKNCSFNTTTELRDKKQKVYALFYKPD

VVPLNGGEHNETGEYILINCNSSTCTQACPKVSFDPIPIHYCAPAGYAIL

KCNNKTFNGTGPCNNVSTVQCTHGIKPVVSTQLLLNGSLAEEEIIVRSEN

LTNNIKTIIVHLNKSVEIKCTRPNNNTRKSVRIGPGQTFYATGEIIGDIR

EAHCNISRETWNSTLIQVKEKLREHYNKTIKFEPSSGGDLEVTTHSFNCR

GEFFYCDTTKLFNETKLFNESEYVDNKTIILPCRIKQIINMWQEVGRCMY

APPIEGNITCKSNITGLLLTWDGGENSTEGVFRPGGGNMKDNWRSELYKY

KVVKIEPLGVAPTRCKRRVVGRRRRRRAVGIGAVFLGFLGAAGSTMGAAS

MTLTVQARNLLSGIVQQQSNLLRAPEAQQHLLKLTVWGIKQLQARVLAVE

RYLRDQQLLGIWGCSGKLICCTNVPWNSSWSNRNLSEIWDNMTWLQWDKE

ISNYTQIIYGLLEESQNQQEKNEQDLLALDggsgggsgEYGSHGNVATEL

QAYAKLHLERSYDYLLSAAYFNNYQTNRAGFSKLFKKLSDEAWSKTIDII

KHVTKRGDKMNFDQHSTMKTERKNYTAENHELEALAKALDTQKELAERAF

YIHREATRNSQHLHDPEIAQYLEEEFIEDHAEKIRTLAGHTSDLKKFITA

NNGHDLSLALYVFDEYLQKTV 25925-chim_ds201-433_iFerr-L-nt30_8ln
                                            (SEQ ID NO: 70)
AENLWVTVYYGVPVWKEAKATLFCASDAKAYETEVHNVWATHACVPTDPN

PQEIVLENVTENFNMWENDMVNQMHEDVISLWDQSLKPCVKLTPLCVTLD

CENVDGNDTYNGTNEMKNCSFNTTTELRDKKQKVSALFYRLDIVPLNRSS

SSNSSDYYRLISCNTSACTQACPKVTFDPIPIHYCAPAGFAILKCNNKTF

NGTGPCHNVSTVQCTHGIKPVVSTQLLLNGSLAEKEIIIRSKNLSDNVKT

IIVHLNESVEIVCTRPNNNTRKSIRIGPGQTFYATGAIIGNIREAHCNIS
```

```
RDKWNETLQRVGKKLEEQFPNKTINFTSSSGGDLEITTHSFNCRGEFFYC
NTSKLFNSTYIPTYRPNNTQGNSSSTITIPCRIKQIINMWQEVGRCMYAP
PIAGNITCKSHITGLLLVRDGGTGLNSSTETFRPGGGDMRDNWRSELYKY
KVVKIEPLGVAPTRCKRRVVGRRRRRRAVGIGAVFLGFLGAAGSTMGAAS
MTLTVQARNLLSGIVQQQSNLLRAPEAQQHLLKLTVWGIKQLQARVLAVE
RYLRDQQLLGIWGCSGKLICCTNVPWNSSWSNRNLSEIWDNMTWLQWDKE
ISNYTQIIYGLLEESQNQQEKNEQDLLALDggsgggsgEYGSHGNVATEL
QAYAKLHLERSYDYLLSAAYFNNYQTNRAGFSKLFKKLSDEAWSKTIDII
KHVTKRGDKMNFDQHSTMKTERKNYTAENHELEALAKALDTQKELAERAF
YIHREATRNSQHLHDPEIAQYLEEEFIEDHAEKIRTLAGHTSDLKKFITA
NNGHDLSLALYVFDEYLQKTV
CNE58-SUstrandC-chim_ds201-433_iFerr-H-nt19_2ln
                                            (SEQ ID NO: 71)
AENLWVTVYYGVPVWKEAKTTLFCASDAKAYETEVHNVWATHACVPTDPN
PQEMVLENVTENFNMWKNEMATQMHEDVISLWDQSLKPCVKLTPLCVTLD
CKNVTLNCGNDTSGNDTLECEKGTNNETYDESVKELRNCSFNATTEVRDK
KKKEYALFYSLDIVPLKNSSEQYRLISCDTSACTQACPKVTFDPIPIHYC
TPAGYAILKCNNKTFNGTGPCNNVSTVQCTHGIKPVVSTQLLLNGSLAEE
EIIVRSENITNNVKTIIVHLNQSVEIVCTRPNNNTRKSIRIGPGQTFYAT
GEIIGDIRQAHCNITKSNWHKTLQEVSKKLAGYFPNKTIIFNSSSGGDLE
ITTHSFNCRGEFFYCNTSSLFNSTYMSNGTYMFNDMSNGTERNSSSIIAI
PCRIKQVINMWQEVGRCMYAPPIAGKLTCRSNITGLLLVRDGGTNNATTE
TFRPGGGDMRNNWRSELYKYKVVKIEPLGVAPTRCKRRVVGRRRRRRAVG
IGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD
ggRSCRNSMRQQIQMEVGASLQYLAMGAHFSKDVVNRPGFAQLFFDAASE
EREHAMKLIEYLLMRGELTNDVSSLLQVRPPTRSSWKGGVEALEHALSME
SDVTKSIRNVIKACEDDSEFNDYHLVDYLTGDFLEEQYKGQRDLAGKAST
LKKLMDRHEALGEFIFDKKLLGIDV
CNE58-SUstrandC-chim_ds201-433_iFerr-L-nt30_5ln
                                            (SEQ ID NO: 72)
AENLWVTVYYGVPVWKEAKTTLFCASDAKAYETEVHNVWATHACVPTDPN
PQEMVLENVTENFNMWKNEMATQMHEDVISLWDQSLKPCVKLTPLCVTLD
CKNVTLNCGNDTSGNDTLECEKGTNNETYDESVKELRNCSFNATTEVRDK
KKKEYALFYSLDIVPLKNSSEQYRLISCDTSACTQACPKVTFDPIPIHYC
TPAGYAILKCNNKTFNGTGPCNNVSTVQCTHGIKPVVSTQLLLNGSLAEE
EIIVRSENITNNVKTIIVHLNQSVEIVCTRPNNNTRKSIRIGPGQTFYAT
GEIIGDIRQAHCNITKSNWHKTLQEVSKKLAGYFPNKTIIFNSSSGGDLE
ITTHSFNCRGEFFYCNTSSLFNSTYMSNGTYMFNDMSNGTERNSSSIIAI
PCRIKQVINMWQEVGRCMYAPPIAGKLTCRSNITGLLLVRDGGTNNATTE
TFRPGGGDMRNNWRSELYKYKVVKIEPLGVAPTRCKRRVVGRRRRRRAVG
IGAVFLGFLGAAGSTMGAASMTLTVQARNLLSGIVQQQSNLLRAPEAQQH
LLKLTVWGIKQLQARVLAVERYLRDQQLLGIWGCSGKLICCTNVPWNSSW
SNRNLSEIWDNMTWLQWDKEISNYTQIIYGLLEESQNQQEKNEQDLLALD
ggsggEYGSHGNVATELQAYAKLHLERSYDYLLSAAYFNNYQTNRAGFSK
LFKKLSDEAWSKTIDIIKHVTKRGDKMNFDQHSTMKTERKNYTAENHELE
ALAKALDTQKELAERAFYIHREATRNSQHLHDPEIAQYLEEEFIEDHAEK
IRTLAGHTSDLKKFITANNGHDLSLALYVFDEYLQKTV
ZM53-chim_ds201-433_iFerr-H-nt19_2ln
                                            (SEQ ID NO: 73)
AENLWVTVYYGVPVWREAKTTLFCASDAKAYEREVHNVWATHACVPTDPN
PQEMVLENVTENFNMWKNDMVDQMQEDIISLWDQSLKPCVKLTPLCVTLN
CSKLNNATDGEMKNCSFNATTELRDKKKQVYALFYKLDIVPLDGRNNSSE
YRLINCNTSTCTQACPKVSFDPIPIHYCAPAGYAILKCNNKTFNGTGPCH
NVSTVQCTHGIKPVISTQLLLNGSTAEEDIIRSENLTNNAKTIIVHLNE
SIEIECTRPGNNTRKSIRIGPGQAFFATTNIIGDIRQAYCIINKANWTNT
LHRVSKKLEEHFPNKTINFNSSSGGDLEITTHSFNCGGEFFYCNTSSLFN
GTYNDTDIYNSTDIILLCRIKQIINMWQEVGRCMYAPPIEGNITCSSNIT
GLLLTRDGGLTNESKETFRPGGGDMRDNWRSELYKYKVVKIEPLGVAPTR
CKRRVVGRRRRRRAVGIGAVFLGFLGAAGSTMGAASMTLTVQARNLLSGI
VQQQSNLLRAPEAQQHLLKLTVWGIKQLQARVLAVERYLRDQQLLGIWGC
SGKLICCTNVPWNSSWSNRNLSEIWDNMTWLQWDKEISNYTQIIYGLLEE
SQNQQEKNEQDLLALDggRSCRNSMRQQIQMEVGASLQYLAMGAHFSKDV
VNRPGFAQLFFDAASEEREHAMKLIEYLLMRGELTNDVSSLLQVRPPTRS
SWKGGVEALEHALSMESDVTKSIRNVIKACEDDSEFNDYHLVDYLTGDFL
EEQYKGQRDLAGKASTLKKLMDRHEALGEFIFDKKLLGIDV
CNE55-glyc332-chim_ds201-433_iFerr-H-nt19_2ln
                                            (SEQ ID NO: 74)
AENLWVTVYYGVPVWRDADTTLFCASDAKAHETEVHNVWATHACVPTDPN
PQEIHLVNVTENFNMWKNKMVEQMQEDVISLWDESLKPCVKLTPLCVTLN
CTTANTNETKNNTTDDNIKDEMKNCTFNMTTEIRDKKQRVSALFYKLDIV
PIDDSKNNSEYRLINCNTSVCKQACPKVSFDPIPIHYCTPAGYVILKCND
KNFNGTGPCKNVSSVQCTHGIKPVVSTQLLLNGSLAEEEIIRSENLTDN
AKNIIVHLNKSVEINCTRPSNNTRTSVRIGPGQVFYRTGDITGDIRKAYC
NISGTEWNKTLTQVAEKLKEHFNKTIVYQPPSGGDLEITMHHFNCRGEFF
YCNTTQLFNNSVGNSTIKLPCRIKQIINMWQGVGQCMYAPPISGAINCLS
NITGILLTRDGGGNNRSNETFRPGGGNIKDNWRSELYKYKVVKIEPLGVA
PTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLLGI
WGCSGKLICCTNVPWNSSWSNRNLSEIWDNMTWLQWDKEISNYTQIIYGL
LEESQNQQEKNEQDLLALDggRSCRNSMRQQIQMEVGASLQYLAMGAHFS
KDVVNRPGFAQLFFDAASEEREHAMKLIEYLLMRGELTNDVSSLLQVRPP
TRSSWKGGVEALEHALSMESDVTKSIRNVIKACEDDSEFNDYHLVDYLTG
DFLEEQYKGQRDLAGKASTLKKLMDRHEALGEFIFDKKLLGIDV
```

P0402-chim_ds201-433_iFerr-H-nt19_2ln
(SEQ ID NO: 75)
AENLWVTVYYGVPVWEDADTPLFCASDAKAYSTESHNVWATHACVPTDPS
PQEISLDNVTENFNMWKNNMVEQMHEDIISLWDESLKPCVKLTPLCVTLN
CTNVNNSSATNNSMVDDREGLKNCSFNITTELRDKKKQEHALFYRLDIVP
INGNSNSNSSVGDYRLINCNVSTCKQACPKMSFDPIPIHYCAPAGFAILK
CRDKKFNGTGSCKNVSTVQCTHGIKPVISTQLLLNGSVAEEEIMIRSENF
TNNAKNIIVQFNKTIDIMCTRPNNNTRKSISLGPGQAIYATGDIIGNIRQ
AHCNISGADWGNMIRNVSEKLKEIFNKTTITFKASAGGDLEITTHSFNCR
GEFFYCDTSDLFNSSRFNNSSNDTNDTITLPCKIKQIVRMWQRVGQCMYA
PPIAGNITCRSNITGLLLTRDGGGNNTNETETFRPAGGDMRDNWRSELYK
YKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggRSCRNSMRQQIQMEVGA
SLQYLAMGAHFSKDVVNRPGFAQLFFDAASEEREHAMKLIEYLLMRGELT
NDVSSLLQVRPPTRSSWKGGVEALEHALSMESDVTKSIRNVIKACEDDSE
FNDYHLVDYLTGDFLEEQYKGQRDLAGKASTLKKLMDRHEALGEFIFDKK
LLGIDV X1193-chim_ds201-433_iFerr-H-nt19_2ln
(SEQ ID NO: 76)
AENLWVTVYYGVPVWEDADTTLFCASDAKAYSTESHNVWATHACVPTDPN
PQEIPLKNVTENFNMWKNNMVEQMHEDIISLWDESLKPCVKLTPLCVTLI
CTNVTSNSTNSTNGVTNNSTVDYREQLKNCSFNITTEIRDKQRKEYALFY
RLDIVPINDNEKNDTYRLINCNVSTCKQACPKVTFDPIPIHYCAPAGFAI
LKCRDKKFNGTGPCKNVSTVQCTHGIKPVISTQLLLNGSLAEGDIMIRSE
NITDNAKTIIVQLKTAVNITCTRPSNNTRKSIRFGPGQAFYATDEIIGDI
RQAHCNISKTEWEDMKRNVSDKLKALFNNKTIIFKSSSGGDLEITTHSFN
CRGEFFYCNTSGLFNTSGLFNNNSNDSSGNITLPCKIKQIVRMWQRVGQC
MYAPPIAGNITCRSRITGLLLVRDGGKSNETNGTETFRPAGGDMRDNWRS
ELYKYKVVKIEPLGVAPTRCKRRVVGRRRRRRAVGIGAVFLGFLGAAGST
MGAASMTLTVQARNLLSGIVQQQSNLLRAPEAQQHLLKLTVWGIKQLQAR
VLAVERYLRDQQLLGIWGCSGKLICCTNVPWNSSWSNRNLSEIWDNMTWL
QWDKEISNYTQIIYGLLEESQNQQEKNEQDLLALDggRSCRNSMRQQIQM
EVGASLQYLAMGAHFSKDVVNRPGFAQLFFDAASEEREHAMKLIEYLLMR
GELTNDVSSLLQVRPPTRSSWKGGVEALEHALSMESDVTKSIRNVIKACE
DDSEFNDYHLVDYLTGDFLEEQYKGQRDLAGKASTLKKLMDRHEALGEFI
FDKKLLGIDV DU156.12-chim_ds201-433_iFerr-H-nt19_2ln
(SEQ ID NO: 77)
AENLWVTVYYGVPVWTEAKTTLFCASDAKAYEKEVHNVWATHACVPTDPN
PQEIFLKNVTENFNMWKNDMVEQMHEDIISLWDQSLKPCVKLTPLCVTLN
CVTYNNSMNSSATYNNSMNGEIKNCSFNTTTELRDKKKQKVYALFYRTDVV
PLNNNNNNSEYILINCNTSTCTQACPKVSFDPIPIHYCAPAGYAILKCTD KKFNGTGSCNNVSTVQCTHGIKPVVSTQLLLNGSLAEEEIIIKSENLTDN
IKTIIVQLNQSIGINCTRPNNNTRKSVRIGPGQTFYATGDIIGDIRQAHC
NISRNQWNETLEQVKKKLGEHFHNQTKIKFEPPSGGDLEITTHSFNCRGE
FFYCNTADLFTNATKLVNDTENKAVITIPCRIKQIINMWQGVGRCMYAPP
IEGNITCNSNITGLLLTRDGGGNVTEINRTEIFRPGGGNMKDNWRSELYK
YKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggRSCRNSMRQQIQMEVGA
SLQYLAMGAHFSKDVVNRPGFAQLFFDAASEEREHAMKLIEYLLMRGELT
NDVSSLLQVRPPTRSSWKGGVEALEHALSMESDVTKSIRNVIKACEDDSE
FNDYHLVDYLTGDFLEEQYKGQRDLAGKASTLKKLMDRHEALGEFIFDKK
LLGIDV DU422.01-chim_ds201-433_iFerr-H-nt19_2ln
(SEQ ID NO: 78)
AENLWVTVYYGVPVWKEAKTTLFCASDAKAYDKEVHNVWATHACVPTDPN
PQEIVLENVTENFNMWKNDMVDQMHEDIISLWDQSLKPCVKLTPLCVTLN
CKNVNISANANATATLNSSMNGEIKNCSFNTTTELRDKKQKVYALFYKPD
VVPLNGGEHNETGEYILINCNSSTCTQACPKVSFDPIPIHYCAPAGYAIL
KCNNKTFNGTGPCNNVSTVQCTHGIKPVVSTQLLLNGSLAEEEIIVRSEN
LTNNIKTIIVHLNKSVEIKCTRPNNNTRKSVRIGPGQTFYATGEIIGDIR
EAHCNISRETWNSTLIQVKEKLREHYNKTIKFEPSSGGDLEVTTHSFNCR
GEFFYCDTTKLFNETKLFNESEYVDNKTIILPCRIKQIINMWQEVGRCMY
APPIEGNITCKSNITGLLLTWDGGENSTEGVFRPGGGNMKDNWRSELYKY
KVVKIEPLGVAPTRCKRRVVGRRRRRRAVGIGAVFLGFLGAAGSTMGAAS
MTLTVQARNLLSGIVQQQSNLLRAPEAQQHLLKLTVWGIKQLQARVLAVE
RYLRDQQLLGIWGCSGKLICCTNVPWNSSWSNRNLSEIWDNMTWLQWDKE
ISNYTQIIYGLLEESQNQQEKNEQDLLALDggRSCRNSMRQQIQMEVGAS
LQYLAMGAHFSKDVVNRPGFAQLFFDAASEEREHAMKLIEYLLMRGELTN
DVSSLLQVRPPTRSSWKGGVEALEHALSMESDVTKSIRNVIKACEDDSEF
NDYHLVDYLTGDFLEEQYKGQRDLAGKASTLKKLMDRHEALGEFIFDKKL
LGIDV ZM53-chim_ds201-433_iFerr-L-nt30_5ln
(SEQ ID NO: 79)
AENLWVTVYYGVPVWREAKTTLFCASDAKAYEREVHNVWATHACVPTDPN
PQEMVLENVTENFNMWKNDMVDQMQEDIISLWDQSLKPCVKLTPLCVTLN
CSKLNNATDGEMKNCSFNATTELRDKKKQVYALFYKLDIVPLDGRNNSSE
YRLINCNTSTCTQACPKVSFDPIPIHYCAPAGYAILKCNNKTFNGTGPCH
NVSTVQCTHGIKPVISTQLLLNGSTAEEDIIIRSENLTNNAKTIIVHLNE
SIEIECTRPGNNTRKSIRIGPGQAFFATTNIIGDIRQAYCIINKANWTNT
LHRVSKKLEEHFPNKTINFNSSSGGDLEITTHSFNCGGEFFYCNTSSLFN
GTYNDTDIYNSTDIILLCRIKQIINMWQEVGRCMYAPPIEGNITCSSNIT

```
GLLLTRDGGLTNESKETFRPGGGDMRDNWRSELYKYKVVKIEPLGVAPTR
CKRRVVGRRRRRRAVGIGAVFLGFLGAAGSTMGAASMTLTVQARNLLSGI
VQQQSNLLRAPEAQQHLLKLTVWGIKQLQARVLAVERYLRDQQLLGIWGC
SGKLICCTNVPWNSSWSNRNLSEIWDNMTWLQWDKEISNYTQIIYGLLEE
SQNQQEKNEQDLLALDggsggEYGSHGNVATELQAYAKLHLERSYDYLLS
AAYFNNYQTNRAGFSKLFKKLSDEAWSKTIDIIKHVTKRGDKMNFDQHST
MKTERKNYTAENHELEALAKALDTQKELAERAFYIHREATRNSQHLHDPE
IAQYLEEEFIEDHAEKIRTLAGHTSDLKKFITANNGHDLSLALYVFDEYL
QKTV
CNE55-glyc332-chim_ds201-433_iFerr-L-nt30_5ln
                                       (SEQ ID NO: 80)
AENLWVTVYYGVPVWRDADTTLFCASDAKAHETEVHNVWATHACVPTDPN
PQEIHLVNVTENFNMWKNKMVEQMQEDVISLWDESLKPCVKLTPLCVTLN
CTTANTNETKNNTTDDNIKDEMKNCTFNMTTEIRDKKQRVSALFYKLDIV
PIDDSKNNSEYRLINCNTSVCKQACPKVSFDPIPIHYCTPAGYVILKCND
KNFNGTGPCKNVSSVQCTHGIKPVVSTQLLLNGSLAEEEIIIRSENLTDN
AKNIIVHLNKSVEINCTRPSNNTRTSVRIGPGQVFYRTGDITGDIRKAYC
NISGTEWNKTLTQVAEKLKEHFNKTIVYQPPSGGDLEITMHHFNCRGEFF
YCNTTQLFNNSVGNSTIKLPCRIKQIINMWQGVGQCMYAPPISGAINCLS
NITGILLTRDGGGNNRSNETFRPGGGNIKDNWRSELYKYKVVKIEPLGVA
PTRCKRRVVGRRRRRRAVGIGAVFLGFLGAAGSTMGAASMTLTVQARNLL
SGIVQQQSNLLRAPEAQQHLLKLTVWGIKQLQARVLAVERYLRDQQLLGI
WGCSGKLICCTNVPWNSSWSNRNLSEIWDNMTWLQWDKEISNYTQIIYGL
LEESQNQQEKNEQDLLALDggsggEYGSHGNVATELQAYAKLHLERSYDY
LLSAAYFNNYQTNRAGFSKLFKKLSDEAWSKTIDIIKHVTKRGDKMNFDQ
HSTMKTERKNYTAENHELEALAKALDTQKELAERAFYIHREATRNSQHLH
DPEIAQYLEEEFIEDHAEKIRTLAGHTSDLKKFITANNGHDLSLALYVFD
EYLQKTV
P0402-chim_ds201-433_iFerr-L-nt30_5ln
                                       (SEQ ID NO: 81)
AENLWVTVYYGVPVWEDADTPLFCASDAKAYSTESHNVWATHACVPTDPS
PQEISLDNVTENFNMWKNNMVEQMHEDIISLWDESLKPCVKLTPLCVTLN
CTNVNNSSATNNSMVDDREGLKNCSFNITTELRDKKKQEHALFYRLDIVP
INGNSNSNSSVGDYRLINCNVSTCKQACPKMSFDPIPIHYCAPAGFAILK
CRDKKFNGTGSCKNVSTVQCTHGIKPVISTQLLLNGSVAEEEIMIRSENF
TNNAKNIIVQFNKTIDIMCTRPNNNTRKSISLGPGQAIYATGDIIGNIRQ
AHCNISGADWGNMIRNVSEKLKEIFNKTTITFKASAGGDLEITTHSFNCR
GEFFYCDTSDLFNSSRFNNSSNDTNDTITLPCKIKQIVRMWQRVGQCMYA
PPIAGNITCRSNITGLLLTRDGGGNNTNETETFRPAGGDMRDNWRSELYK
YKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggsggEYGSHGNVATELQA
YAKLHLERSYDYLLSAAYFNNYQTNRAGFSKLFKKLSDEAWSKTIDIIKH
VTKRGDKMNFDQHSTMKTERKNYTAENHELEALAKALDTQKELAERAFYI
HREATRNSQHLHDPEIAQYLEEEFIEDHAEKIRTLAGHTSDLKKFITANN
GHDLSLALYVFDEYLQKTV
X1193-chim_ds201-433_iFerr-L-nt30_5ln
                                       (SEQ ID NO: 82)
AENLWVTVYYGVPVWEDADTTLFCASDAKAYSTESHNVWATHACVPTDPN
PQEIPLKNVTENFNMWKNNMVEQMHEDIISLWDESLKPCVKLTPLCVTLI
CTNVTSNSTNSTNGVTNNSTVDYREQLKNCSFNITTEIRDKQRKEYALFY
RLDIVPINDNEKNDTYRLINCNVSTCKQACPKVTFDPIPIHYCAPAGFAI
LKCRDKKFNGTGPCKNVSTVQCTHGIKPVISTQLLLNGSLAEGDIMIRSE
NITDNAKTIIVQLKTAVNITCTRPSNNTRKSIRFGPGQAFYATDEIIGDI
RQAHCNISKTEWEDMKRNVSDKLKALFNNKTIIFKSSSGGDLEITTHSFN
CRGEFFYCNTSGLFNTSGLFNNNSNDSSGNITLPCKIKQIVRMWQRVGQC
MYAPPIAGNITCRSRITGLLLVRDGGKSNETNGTETFRPAGGDMRDNWRS
ELYKYKVVKIEPLGVAPTRCKRRVVGRRRRRRAVGIGAVFLGFLGAAGST
MGAASMTLTVQARNLLSGIVQQQSNLLRAPEAQQHLLKLTVWGIKQLQAR
VLAVERYLRDQQLLGIWGCSGKLICCTNVPWNSSWSNRNLSEIWDNMTWL
QWDKEISNYTQIIYGLLEESQNQQEKNEQDLLALDggsggEYGSHGNVAT
ELQAYAKLHLERSYDYLLSAAYFNNYQTNRAGFSKLFKKLSDEAWSKTID
IIKHVTKRGDKMNFDQHSTMKTERKNYTAENHELEALAKALDTQKELAER
AFYIHREATRNSQHLHDPEIAQYLEEEFIEDHAEKIRTLAGHTSDLKKFI
TANNGHDLSLALYVFDEYLQKTV
DU156.12-chim_ds201-433_iFerr-L-nt30_5ln
                                       (SEQ ID NO: 83)
AENLWVTVYYGVPVWTEAKTTLFCASDAKAYEKEVHNVWATHACVPTDPN
PQEIFLKNVTENFNMWKNDMVDQMHEDIISLWDQSLKPCVKLTPLCVTLN
CVTYNNSMNSSATYNNSMNGEIKNCSFNTTTELRDKKQKVYALFYRTDVV
PLNNNNNNSEYILINCNTSTCTQACPKVSFDPIPIHYCAPAGYAILKCTD
KKFNGTGSCNNVSTVQCTHGIKPVVSTQLLLNGSLAEEEIIIKSENLTDN
IKTIIVQLNQSIGINCTRPNNNTRKSVRIGPGQTFYATGDIIGDIRQAHC
NISRNQWNETLEQVKKKLGEHFHNQTKIKFEPPSGGDLEITTHSFNCRGE
FFYCNTADLFTNATKLVNDTENKAVITIPCRIKQIINMWQGVGRCMYAPP
IEGNITCNSNITGLLLTRDGGGNVTEINRTEIFRPGGGNMKDNWRSELYK
YKVVKIEPLGVAPTRCKRRVVGRRRRRRAVGIGAVFLGFLGAAGSTMGAA
SMTLTVQARNLLSGIVQQQSNLLRAPEAQQHLLKLTVWGIKQLQARVLAV
ERYLRDQQLLGIWGCSGKLICCTNVPWNSSWSNRNLSEIWDNMTWLQWDK
EISNYTQIIYGLLEESQNQQEKNEQDLLALDggsggEYGSHGNVATELQA
YAKLHLERSYDYLLSAAYFNNYQTNRAGFSKLFKKLSDEAWSKTIDIIKH
VTKRGDKMNFDQHSTMKTERKNYTAENHELEALAKALDTQKELAERAFYI
HREATRNSQHLHDPEIAQYLEEEFIEDHAEKIRTLAGHTSDLKKFITANN
GHDLSLALYVFDEYLQKTV
```

-continued

DU422.01-chim_ds201-433_iFerr-L-nt30_5ln
(SEQ ID NO: 84)
AENLWVTVYYGVPVWKEAKTTLFCASDAKAYDKEVHNVWATHACVPTDPN

PQEIVLENVTENFNMWKNDMVDQMHEDIISLWDQSLKPCVKLTPLCVTLN

CKNVNISANANATATLNSSMNGEIKNCSFNTTTELRDKKQKVYALFYKPD

VVPLNGGEHNETGEYILINCNSSTCTQACPKVSFDPIPIHYCAPAGYAIL

KCNNKTFNGTGPCNNVSTVQCTHGIKPVVSTQLLLNGSLAEEEIIVRSEN

LTNNIKTIIVHLNKSVEIKCTRPNNNTRKSVRIGPGQTFYATGEIIGDIR

EAHCNISRETWNSTLIQVKEKLREHYNKTIKFEPSSGGDLEVTTHSFNCR

GEFFYCDTTKLFNETKLFNESEYVDNKTIILPCRIKQIINMWQEVGRCMY

APPIEGNITCKSNITGLLLTWDGGENSTEGVFRPGGGNMKDNWRSELYKY

KVVKIEPLGVAPTRCKRRVVGRRRRRRAVGIGAVFLGFLGAAGSTMGAAS

MTLTVQARNLLSGIVQQQSNLLRAPEAQQHLLKLTVWGIKQLQARVLAVE

RYLRDQQLLGIWGCSGKLICCTNVPWNSSWSNRNLSEIWDNMTWLQWDKE

ISNYTQIIYGLLEESQNQQEKNEQDLLALDggsggEYGSHGNVATELQAY

AKLHLERSYDYLLSAAYFNNYQTNRAGFSKLFKKLSDEAWSKTIDIIKHV

TKRGDKMNFDQHSTMKTERKNYTAENHELEALAKALDTQKELAERAFYIH

REATRNSQHLHDPEIAQYLEEEFIEDHAEKIRTLAGHTSDLKKFITANNG

HDLSLALYVFDEYLQKTV

Any of the above recombinant insect ferritin light chain fusion proteins including an HIV-1 ectodomain can be paired with any of the above recombinant insect ferritin heavy chain fusion proteins including an HIV-1 ectodomain to generate a recombinant insect ferritin nanoparticle that display HIV-1 Env ectodomains on its surface. In some embodiments, the recombinant insect ferritin nanoparticle can comprise a recombinant insect ferritin light chain fusion protein and a recombinant insect ferritin heavy chain fusion protein respectively comprising one of the following pairs of SEQ ID NOs: 26 and 28, 26 and 29, 26 and 30, 26 and 31, 26 and 32, 26 and 33, 26 and 34, 26 and 35, 26 and 36, 26 and 37, 26 and 38, 26 and 39, 26 and 40, 26 and 41, 26 and 42, 26 and 43, 26 and 44, 26 and 45, 26 and 46, 26 and 47, 26 and 48, 26 and 49, 26 and 50, 26 and 51, 26 and 52, 26 and 55, 26 and 59, 26 and 60, 26 and 61, 26 and 62, 26 and 63, 26 and 71, 26 and 73, 26 and 74, 26 and 75, 26 and 76, 26 and 77, 26 and 78, 27 and 28, 27 and 29, 27 and 30, 27 and 31, 27 and 32, 27 and 33, 27 and 34, 27 and 35, 27 and 36, 27 and 37, 27 and 38, 27 and 39, 27 and 40, 27 and 41, 27 and 42, 27 and 43, 27 and 44, 27 and 45, 27 and 46, 27 and 47, 27 and 48, 27 and 49, 27 and 50, 27 and 51, 27 and 52, 27 and 55, 27 and 59, 27 and 60, 27 and 61, 27 and 62, 27 and 63, 27 and 71, 27 and 73, 27 and 74, 27 and 75, 27 and 76, 27 and 77, 27 and 78, 53 and 28, 53 and 29, 53 and 30, 53 and 31, 53 and 32, 53 and 33, 53 and 34, 53 and 35, 53 and 36, 53 and 37, 53 and 38, 53 and 39, 53 and 40, 53 and 41, 53 and 42, 53 and 43, 53 and 44, 53 and 45, 53 and 46, 53 and 47, 53 and 48, 53 and 49, 53 and 50, 53 and 51, 53 and 52, 53 and 55, 53 and 59, 53 and 60, 53 and 61, 53 and 62, 53 and 63, 53 and 71, 53 and 73, 53 and 74, 53 and 75, 53 and 76, 53 and 77, 53 and 78, 54 and 28, 54 and 29, 54 and 30, 54 and 31, 54 and 32, 54 and 33, 54 and 34, 54 and 35, 54 and 36, 54 and 37, 54 and 38, 54 and 39, 54 and 40, 54 and 41, 54 and 42, 54 and 43, 54 and 44, 54 and 45, 54 and 46, 54 and 47, 54 and 48, 54 and 49, 54 and 50, 54 and 51, 54 and 52, 54 and 55, 54 and 59, 54 and 60, 54 and 61, 54 and 62, 54 and 63, 54 and 71, 54 and 73, 54 and 74, 54 and 75, 54 and 76, 54 and 77, 54 and 78, 64 and 28, 64 and 29, 64 and 30, 64 and 31, 64 and 32, 64 and 33, 64 and 34, 64 and 35, 64 and 36, 64 and 37, 64 and 38, 64 and 39, 64 and 40, 64 and 41, 64 and 42, 64 and 43, 64 and 44, 64 and 45, 64 and 46, 64 and 47, 64 and 48, 64 and 49, 64 and 50, 64 and 51, 64 and 52, 64 and 55, 64 and 59, 64 and 60, 64 and 61, 64 and 62, 64 and 63, 64 and 71, 64 and 73, 64 and 74, 64 and 75, 64 and 76, 64 and 77, 64 and 78, 65 and 28, 65 and 29, 65 and 30, 65 and 31, 65 and 32, 65 and 33, 65 and 34, 65 and 35, 65 and 36, 65 and 37, 65 and 38, 65 and 39, 65 and 40, 65 and 41, 65 and 42, 65 and 43, 65 and 44, 65 and 45, 65 and 46, 65 and 47, 65 and 48, 65 and 49, 65 and 50, 65 and 51, 65 and 52, 65 and 55, 65 and 59, 65 and 60, 65 and 61, 65 and 62, 65 and 63, 65 and 71, 65 and 73, 65 and 74, 65 and 75, 65 and 76, 65 and 77, 65 and 78, 66 and 28, 66 and 29, 66 and 30, 66 and 31, 66 and 32, 66 and 33, 66 and 34, 66 and 35, 66 and 36, 66 and 37, 66 and 38, 66 and 39, 66 and 40, 66 and 41, 66 and 42, 66 and 43, 66 and 44, 66 and 45, 66 and 46, 66 and 47, 66 and 48, 66 and 49, 66 and 50, 66 and 51, 66 and 52, 66 and 55, 66 and 59, 66 and 60, 66 and 61, 66 and 62, 66 and 63, 66 and 71, 66 and 73, 66 and 74, 66 and 75, 66 and 76, 66 and 77, 66 and 78, 67 and 28, 67 and 29, 67 and 30, 67 and 31, 67 and 32, 67 and 33, 67 and 34, 67 and 35, 67 and 36, 67 and 37, 67 and 38, 67 and 39, 67 and 40, 67 and 41, 67 and 42, 67 and 43, 67 and 44, 67 and 45, 67 and 46, 67 and 47, 67 and 48, 67 and 49, 67 and 50, 67 and 51, 67 and 52, 67 and 55, 67 and 59, 67 and 60, 67 and 61, 67 and 62, 67 and 63, 67 and 71, 67 and 73, 67 and 74, 67 and 75, 67 and 76, 67 and 77, 67 and 78, 68 and 28, 68 and 29, 68 and 30, 68 and 31, 68 and 32, 68 and 33, 68 and 34, 68 and 35, 68 and 36, 68 and 37, 68 and 38, 68 and 39, 68 and 40, 68 and 41, 68 and 42, 68 and 43, 68 and 44, 68 and 45, 68 and 46, 68 and 47, 68 and 48, 68 and 49, 68 and 50, 68 and 51, 68 and 52, 68 and 55, 68 and 59, 68 and 60, 68 and 61, 68 and 62, 68 and 63, 68 and 71, 68 and 73, 68 and 74, 68 and 75, 68 and 76, 68 and 77, 68 and 78, 69 and 28, 69 and 29, 69 and 30, 69 and 31, 69 and 32, 69 and 33, 69 and 34, 69 and 35, 69 and 36, 69 and 37, 69 and 38, 69 and 39, 69 and 40, 69 and 41, 69 and 42, 69 and 43, 69 and 44, 69 and 45, 69 and 46, 69 and 47, 69 and 48, 69 and 49, 69 and 50, 69 and 51, 69 and 52, 69 and 55, 69 and 59, 69 and 60, 69 and 61, 69 and 62, 69 and 63, 69 and 71, 69 and 73, 69 and 74, 69 and 75, 69 and 76, 69 and 77, 69 and 78, 70 and 28, 70 and 29, 70 and 30, 70 and 31, 70 and 32, 70 and 33, 70 and 34, 70 and 35, 70 and 36, 70 and 37, 70 and 38, 70 and 39, 70 and 40, 70 and 41, 70 and 42, 70 and 43, 70 and 44, 70 and 45, 70 and 46, 70 and 47, 70 and 48, 70 and 49, 70 and 50, 70 and 51, 70 and 52, 70 and 55, 70 and 59, 70 and 60, 70 and 61, 70 and 62, 70 and 63, 70 and 71, 70 and 73, 70 and 74, 70 and 75, 70 and 76, 70 and 77, 70 and 78, 72 and 28, 72 and 29, 72 and 30, 72 and 31, 72 and 32, 72 and 33, 72 and 34, 72 and 35, 72 and 36, 72 and 37, 72 and 38, 72 and 39, 72 and 40, 72 and 41, 72 and 42, 72 and 43, 72 and 44, 72 and 45, 72 and 46, 72 and 47, 72 and 48, 72 and 49, 72 and 50, 72 and 51, 72 and 52, 72 and 55, 72 and 59, 72 and 60, 72 and 61, 72 and 62, 72 and 63, 72 and 71, 72 and 73, 72 and 74, 72 and 75, 72 and 76, 72 and 77, 72 and 78, 79 and 28, 79 and 29, 79 and 30, 79 and 31, 79 and 32, 79 and 33, 79 and 34, 79 and 35, 79 and 36, 79 and 37, 79 and 38, 79 and 39, 79 and 40, 79 and 41, 79 and 42, 79 and 43, 79 and 44, 79 and 45, 79 and 46, 79 and 47, 79 and 48, 79 and 49, 79 and 50, 79 and 51, 79 and 52, 79 and 55, 79 and 59, 79 and 60, 79 and 61, 79 and 62, 79 and 63, 79 and 71, 79 and 73, 79 and 74, 79 and 75, 79 and 76, 79 and 77, 79 and 78, 80 and 28, 80 and 29, 80 and 30, 80 and 31, 80 and 32, 80 and 33, 80 and 34, 80 and 35, 80 and 36, 80 and 37, 80 and 38, 80 and 39, 80 and 40, 80 and 41, 80 and 42, 80 and 43, 80 and 44, 80 and 45, 80 and 46, 80 and 47, 80 and 48, 80 and 49, 80 and 50, 80 and 51, 80 and 52, 80 and 55, 80 and 59, 80 and 60, 80 and 61, 80 and 62, 80 and 63, 80 and 71, 80 and 73, 80 and 74, 80 and 75, 80 and 76, 80 and 77, 80 and 78, 81 and 28, 81 and 29, 81 and 30, 81 and 31, 81 and 32, 81 and 33, 81 and 34, 81 and 35, 81 and 36, 81 and 37, 81 and 38, 81 and 39, 81 and 40, 81 and 41, 81 and 42, 81 and 43, 81 and 44, 81 and 45, 81 and 46, 81 and 47, 81 and 48, 81 and 49, 81 and 50, 81 and 51, 81 and 52, 81 and 55, 81 and 59, 81 and 60, 81 and 61, 81 and 62, 81 and 63, 81 and 71, 81 and 73, 81 and 74, 81 and 75, 81 and 76, 81 and 77, 81 and 78, 82 and 28, 82 and 29, 82 and 30, 82 and 31, 82 and 32, 82 and 33, 82 and 34, 82 and 35, 82 and 36, 82 and 37, 82 and 38, 82 and 39, 82 and 40, 82 and 41, 82 and 42, 82 and 43, 82 and 44, 82 and 45, 82 and 46, 82 and 47, 82 and 48, 82 and 49, 82 and 50, 82 and 51, 82 and 52, 82 and 55, 82 and 59, 82 and 60, 82 and 61, 82 and 62, 82 and 63, 82 and 71, 82 and 73, 82 and 74, 82 and 75, 82 and 76, 82 and 77, 82 and 78, 83 and 28, 83 and 29, 83 and 30, 83 and 31, 83 and 32, 83 and 33, 83 and 34, 83 and 35, 83 and 36, 83 and 37, 83 and 38, 83 and 39, 83 and 40, 83 and 41, 83 and 42, 83 and 43, 83 and 44, 83 and 45, 83 and 46, 83 and 47, 83 and 48, 83 and 49, 83 and 50, 83 and 51, 83 and 52, 83 and 55, 83 and 59, 83 and 60, 83 and 61, 83 and 62, 83 and 63, 83 and 71, 83 and 73, 83 and 74, 83 and 75, 83 and 76, 83 and 77, 83 and 78, 84 and 28, 84 and 29, 84 and 30, 84 and 31, 84 and 32, 84 and 33, 84 and 34, 84 and 35, 84 and 36, 84 and 37, 84 and 38, 84 and 39, 84 and 40, 84 and 41, 84 and 42, 84 and 43, 84 and 44, 84 and 45, 84 and 46, 84 and 47, 84 and 48, 84 and 49, 84 and 50, 84 and 51, 84 and 52, 84 and 55, 84 and 59, 84 and 60, 84 and 61, 84 and 62, 84 and 63, 84 and 71, 84 and 73, 84 and 74, 84 and 75, 84 and 76, 84 and 77, or 84 and 78.

2. Influenza HA Ectodomains and HA Stem Proteins

In some embodiments, the insect ferritin heavy chain fusion proteins and/or insect ferritin light chain fusion proteins of the recombinant insect ferritin nanoparticle can comprise first or second proteins that are recombinant influenza HA ectodomains or recombinant influenza HA stem proteins, to produce a recombinant insect ferritin nanoparticle with trimeric influenza HA ectodomains or recombinant influenza HA stem proteins on its surface.

Influenza viruses are enveloped negative-sense viruses belonging to the orthomyxoviridae family. Influenza viruses are classified on the basis of their core proteins into three distinct types: A, B, and C. Within these broad classifications, subtypes are further divided based on the characterization of two antigenic surface proteins hemagglutinin (HA or H) and neuraminidase (NA or N). While B and C type influenza viruses are largely restricted to humans, influenza A viruses are pathogens of a wide variety of species including humans, non-human mammals, and birds. Periodically, non-human strains, particularly of avian influenza, have infected human populations, in some cases causing severe disease with high mortality. Recombination between such avian and non-human mammal strains with human strains in co-infected individuals has given rise to recombinant influenza viruses to which immunity is lacking in the human population, resulting in influenza pandemics. Three such pandemics occurred during the twentieth century (pandemics of 1918, 1957, and 1968) and resulted in numerous deaths world-wide.

The influenza virion consists of an internal ribonucleoprotein core containing the single-stranded RNA genome and an outer lipoprotein envelope lined by a matrix protein. The segmented genome of influenza consists of eight linear RNA molecules that encode ten polypeptides. Two of the polypeptides, HA and NA include the primary antigenic determinants or epitopes required for a protective immune response against influenza. Based on the antigenic characteristics of the HA and NA proteins, influenza strains are classified into subtypes. For example, recent outbreaks of avian influenza in Asia have been categorized as H5N1, H7N7, and H9N2 based on their HA and NA phenotypes.

Influenza HA is a surface glycoprotein which projects from the lipoprotein envelope and mediates attachment to and entry into cells. The HA protein is approximately 566 amino acids in length, and is encoded by an approximately 1780 base polynucleotide sequence of segment 4 of the genome. In cells, individual HA polypeptides form a homotrimer and undergo glycosylation within the Golgi apparatus as well as processing to remove the signal peptide, and cleavage by a cellular protease to generate separate HA1 and HA2 polypeptide chains, which remain associated as HA1-HA2 protomers within the HA homotrimer. An influenza HA ectodomain trimer includes a protein complex of three influenza HA ectodomains.

The globular head of the HA trimer consists exclusively of the major portion of the HA' polypeptide, whereas the stem that anchors the HA protein into the viral lipid envelope is comprised of HA2 and part of HA1. The globular head of a HA protein includes two domains: the receptor binding domain (RBD), an ~148-amino acid residue domain that includes the sialic acid-binding site, and the vestigial esterase domain, a smaller ~75-amino acid residue region just below the RBD. The globular head includes several antigenic sites that include immunodominant epitopes. Examples include the Sa, Sb, $Ca_{1s}$ $Ca_2$ and Cb antigenic sites (see, for example, Caton A J et al, 1982, Cell 31, 417-427). The RBD-A region includes the Sa antigenic site and part of the Sb antigenic site.

Antibodies against influenza often target variable antigenic sites in the globular head of HA, which surround a conserved sialic acid binding site, and thus, neutralize only antigenically closely related viruses. The variability of the HA head is due to the constant antigenic drift of influenza viruses and is responsible for seasonal endemics of influenza. In contrast, the HA stem is highly conserved and experiences little antigenic drift. Unfortunately, unlike the immunodominant head, native HA stem is not very immunogenic.

Polynucleotide and amino acid sequences of HA (and other influenza antigens) isolated from recent, as well as historic, influenza strains can be found, for example in the GENBANK® database (available on the world wide web at ncbi.nlm.nih.gov/entrez) or the influenza Sequence Database of Los Alamos National Laboratories (LANL) (available on the world wide web at flu.lanl.gov). For example, recent H1 subtype HA sequences include: AY038014, and J02144; recent H3 subtype HA sequences include: AY531037, M29257, and U97740; H5 subtype HA sequences include: AY075033, AY075030, AY818135, AF046097, AF046096, and AF046088; recent H7 subtype HA sequences include: AJ704813, AJ704812, and Z47199; and, recent H9 subtype HA sequences include: AY862606, AY743216, and AY664675. Non-limiting examples of influenza HA proteins, the ectodomain of which can be included on a disclosed recombinant insect ferritin nanoparticle are provided below:

(1) H1N1-A/Brevig Mission/1/1918
(SEQ ID NO: 85)
DTICIGYHANNSTDTVDTVLEKNVTVTHSVNLLEDSHNGKLCKLKGIAPLQLGKCNIAGWLLGNPECDLLLTASSWS

YIVETSNSENGTCYPGDFIDYEELREQLSSVSSFEKFEIFPKTSSWPNHETTKGVTAACSYAGASSFYRNLLWLTKK

GSSYPKLSKSYVNNKGKEVLVLWGVHHPPTGTDQQSLYQNADAYVSVGSSKYNRRFTPEIAARPKVRDQAGRMNYYW

TLLEPGDTITFEATGNLIAPWYAFALNRGSGSGIITSDAPVHDCNTKCQTPHGAINSSLPFQNIHPVTIGECPKYVR

STKLRMATGLRNIPSIQSRGLFGAIAGFIEGGWTGMIDGWYGYHHQNEQGSGYAADQKSTQNAIDGITNKVNSVIEK

MNTQFTAVGKEFNNLERRIENLNKKVDDGFLDIWTYNAELLVLLENERTLDFHDSNVRNLYEKVKSQLKNNAKEIGN

GCFEFYHKCDDACMESVRNGTYDYPKYSEESKLNREEIDGVKLESMGVYQILAIYSTVASSLVLLVSLGAISFWMCS

NGSLQCRICI (2) H1N1-A/Brisbane/59/2007

(SEQ ID NO: 86)
DTICIGYHANNSTDTVDTVLEKNVTVTHSVNLLENSHNGKLCLLKGIAPLQLGNCSVAGWILGNPECELLISKESWS

YIVEKPNPENGTCYPGHFADYEELREQLSSVSSFERFEIFPKESSWPNHTVTGVSASCSHNGESSFYRNLLWLTGKN

GLYPNLSKSYANNKEKEVLVLWGVHHPPNIGNQKALYHTENAYVSVVSSHYSRKFTPEIAKRPKVRDQEGRINYYWT

LLEPGDTIIFEANGNLIAPRYAFALSRGFGSGIINSNAPMDKCDAKCQTPQGAINSSLPFQNVHPVTIGECPKYVRS

AKLRMVTGLRNIPSIQSRGLFGAIAGFIEGGWTGMVDGWYGYHHQNEQGSGYAADQKSTQNAINGITNKVNSVIEKM

NTQFTAVGKEFNKLERRMENLNKKVDDGFIDIWTYNAELLVLLENERTLDFHDSNVKNLYEKVKSQLKNNAKEIGNG

CFEFYHKCNDECMESVKNGTYDYPKYSEESKLNREKIDGVKLESMGVYQILAIYSTVASSLVLLVSLGAISFWMCSN

GSLQCRICI (3) H1N1-A/New Caledonia/20/1999

(SEQ ID NO: 87)
DTICIGYHANNSTDTVDTVLEKNVTVTHSVNLLEDSHNGKLCLLKGIAPLQLGNCSVAGWILGNPECELLISKESWS

YIVETPNPENGTCYPGYFADYEELREQLSSVSSFERFEIFPKESSWPNHTVTGVSASCSHNGKSSFYRNLLWLTGKN

GLYPNLSKSYVNNKEKEVLVLWGVHHPPNIGNQRALYHTENAYVSVVSSHYSRRFTPEIAKRPKVRDQEGRINYYWT

LLEPGDTIIFEANGNLIAPWYAFALSRGFGSGIITSNAPMDECDAKCQTPQGAINSSLPFQNVHPVTIGECPKYVRS

AKLRMVTGLRNIPSIQSRGLFGAIAGFIEGGWTGMVDGWYGYHHQNEQGSGYAADQKSTQNAINGITNKVNSVIEKM

NTQFTAVGKEFNKLERRMENLNKKVDDGFLDIWTYNAELLVLLENERTLDFHDSNVKNLYEKVKSQLKNNAKEIGNG

CFEFYHKCNNECMESVKNGTYDYPKYSEESKLNREKIDGVKLESMGVYQILAIYSTVASSLVLLVSLGAISFWMCSN

GSLQCRICI (4) H1N1-A/Puerto Rico/8/1934

(SEQ ID NO: 88)
DTICIGYHANNSTDTVDTVLEKNVTVTHSVNLLEDSHNGKLCRLKGIAPLQLGKCNIAGWLLGNPECDPLLPVRSWS

YIVETPNSENGICYPGDFIDYEELREQLSSVSSFERFEIFPKESSWPNHNTNGVTAACSHEGKSSFYRNLLWLTEKE

GSYPKLKNSYVNKKGKEVLVLWGIHHPPNSKEQQNLYQNENAYVSVVTSNYNRRFTPEIAERPKVRDQAGRMNYYWT

LLKPGDTIIFEANGNLIAPMYAFALSRGFGSGIITSNASMHECNTKCQTPLGAINSSLPYQNIHPVTIGECPKYVRS

AKLRMVTGLRNIPSIQSRGLFGAIAGFIEGGWTGMIDGWYGYHHQNEQGSGYAADQKSTQNAINGITNKVNTVIEKM

NIQFTAVGKEFNKLEKRMENLNKKVDDGFLDIWTYNAELLVLLENERTLDFHDSNVKNLYEKVKSQLKNNAKEIGNG

CFEFYHKCDNECMESVRNGTYDYPKYSEESKLNREKVDGVKLESMGIYQILAIYSTVASSLVLLVSLGAISFWMCSN

GSLQCRICI (5) H1N1-A/Solomon Islands/3/2006

(SEQ ID NO: 89)
DTICIGYHANNSTDTVDTVLEKNVTVTHSVNLLEDSHNGKLCLLKGIAPLQLGNCSVAGWILGNPECELLISRESWS

YIVEKPNPENGTCYPGHFADYEELREQLSSVSSFERFEIFPKESSWPNHTTTGVSASCSHNGESSFYKNLLWLTGKN

GLYPNLSKSYANNKEKEVLVLWGVHHPPNIGDQRALYHTENAYVSVVSSHYSRKFTPEIAKRPKVRDREGRINYYWT

LLEPGDTIIFEANGNLIAPRYAFALSRGFGSGIINSNAPMDECDAKCQTPQGAINSSLPFQNVHPVTIGECPKYVRS

```
AKLRMVTGLRNIPSIQSRGLFGAIAGFIEGGWTGMVDGWYGYHHQNEQGSGYAADQKSTQNAINGITNKVNSVIEKM

NTQFTAVGKEFNKLERRMENLNKKVDDGFIDIWTYNAELLVLLENERTLDFHDSNVKNLYEKVKSQLKNNAKEIGNG

CFEFYHKCNDECMESVKNGTYDYPKYSEESKLNREKIDGVKLESMGVYQILAIYSTVASSRVLLVSLGAISFWMCSN

GSLQCRICI
```

(6) H1N1-A/South Carolina/1/1918

(SEQ ID NO: 90)

DTICIGYHANNSTDTVDTVLEKNVTVTHSVNLLEDSHNGKLCKLKGIAPLQLGKCNIAGWLLGNPECDLLLTASSWS

YIVETSNSENGTCYPGDFIDYEELREQLSSVSSFEKFEIFPKTSSWPNHETTKGVTAACSYAGASSFYRNLLWLTKK

GSSYPKLSKSYVNNKGKEVLVLWGVHHPPTGTDQQSLYQNADAYVSVGSSKYNRRFTPEIAARPKVRDQAGRMNYYW

TLLEPGDTITFEATGNLIAPWYAFALNRGSGSGIITSDAPVHDCNTKCQTPHGAINSSLPFQNIHPVTIGECPKYVR

STKLRMATGLRNIPSIQSRGLFGAIAGFIEGGWTGMIDGWYGYHHQNEQGSGYAADQKSTQNAIDGITNKVNSVIEK

MNTQFTAVGKEFNNLERRIENLNKKVDDGFLDIWTYNAELLVLLENERTLDFHDSNVRNLYEKVKSQLKNNAKEIGN

GCFEFYHKCDDACMESVRNGTYDYPKYSEESKLNREEIDGVKLESMGVYQILAIYSTVASSLVLLVSLGAISFWMCS

NGSLQCRICI (7) H2N2-A/Canada/720/2005

(SEQ ID NO: 91)

DQICIGYHANNSTEKVDTILERNVTVTHAKDILEKTHNGKLCKLNGIPPLELGDCSIAGWLLGNPECDRLLSVPEWS

YIMEKENPRDGLCYPGSFNDYEELKHLLSSVKHFEKVKILPKDRWTQHTTTGGSRACAVSGNPSFFRNMVWLTKKGS

NYPVAQGSYNNTSGEQMLIIWGVHHPNDETEQRTLYQNVGTYVSVGTSTLNKRSTPEIATRPKVNGQGGRMEFSWTL

LDMWDTINFESTGNLIAPEYGFKISKRGSSGIMKTEGTLENCETKCQTPLGAINTTLPFHNVHPLTIGECPKYVKSE

KLVLATGLRNVPQIESRGLFGAIAGFIEGGWQGMVDGWYGYHHSNDQGSGYAADKESTQKAFDGITNKVNSVIEKMN

TQFEAVGKEFSNLERRLENLNKKMEDGFLDVWTYNAELLVLMENERTLDFHDSNVKNLYDKVRMQLRDNVKELGNGC

FEFYHKCDDECMNSVKNGTYDYPKYEEESKLNRNEIKGVKLSSMGVYQILAIYATVAGSLSLAIMMAGISFWMCSNG

SLQCRICI (8) H2N2-A/Singapore/1/1957

(SEQ ID NO: 92)

DQICIGYHANNSTEKVDTILERNVTVTHAKDILEKTHNGKLCKLNGIPPLELGDCSIAGWLLGNPECDRLLSVPEWS

YIMEKENPRDGLCYPGSFNDYEELKHLLSSVKHFEKVKILPKDRWTQHTTTGGSRACAVSGNPSFFRNMVWLTKKGS

NYPVAKGSYNNTSGEQMLIIWGVHHPNDETEQRTLYQNVGTYVSVGTSTLNKRSTPDIATRPKVNGQGGRMEFSWTL

LDMWDTINFESTGNLIAPEYGFKISKRGSSGIMKTEGTLENCETKCQTPLGAINTTLPFHNVHPLTIGECPKYVKSE

KLVLATGLRNVPQIESRGLFGAIAGFIEGGWQGMVDGWYGYHHSNDQGSGYAADKESTQKAFDGITNKVNSVIEKMN

TQFEAVGKEFSNLERRLENLNKKMEDGFLDVWTYNAELLVLMENERTLDFHDSNVKNLYDKVRMQLRDNVKELGNGC

FEFYHKCDDECMNSVKNGTYDYPKYEEESKLNRNEIKGVKLSSMGVYQILAIYATVAGSLSLAIMMAGISFWMCSNG

SLQCRICI (9) H3N2-A/Aichi/2/1968

(SEQ ID NO: 93)

QDLPGNDNSTATLCLGHHAVPNGTLVKTITDDQIEVTNATELVQSSSTGKICNNPHRILDGIDCTLIDALLGDPHCD

VFQNETWDLFVERSKAFSNCYPYDVPDYASLRSLVASSGTLEFITEGFTWTGVTQNGGSNACKRGPGSGFFSRLNWL

TKSGSTYPVLNVTMPNNDNFDKLYIWGIHHPSTNQEQTSLYVQASGRVTVSTRRSQQTIIPNIGSRPWVRGLSSRIS

IYWTIVKPGDVLVINSNGNLIAPRGYFKMRTGKSSIMRSDAPIDTCISECITPNGSIPNDKPFQNVNKITYGACPKY

VKQNTLKLATGMRNVPEKQTRGLFGAIAGFIENGWEGMIDGWYGFRHQNSEGTGQAADLKSTQAAIDQINGKLNRVI

EKTNEKFHQIEKEFSEVEGRIQDLEKYVEDTKIDLWSYNAELLVALENQHTIDLTDSEMNKLFEKTRRQLRENAEEM

GNGCFKIYHKCDNACIESIRNGTYDHDVYRDEALNNRFQIKGVELKSGYKDWILWISFAISCFLLCVVLLGFIMWAC

QRGNIRCNICI

-continued

(10) H3N2-A/Beijing/353/1989

(SEQ ID NO: 94)
QKLPGNDNSTATLCLGHHAVPNGTLVKTITNDQIEVTNATELVQSSSTGRICDSPHRILDGKNCTLIDALLGDPHCD
GFQNKEWDLFVERSKAYSNCYPYDVPDYASLRSLVASSGTLEFINEDFNWTGVAQSGESYACKRGSVKSFFSRLNWL
HESEYKYPALNVTMPNNGKFDKLYIWGVHHPSTDREQTNLYVRASGRVTVSTKRSQQTVIPNIGSRPWVRGLSSRIS
IYWTIVKPGDILLINSTGNLIAPRGYFKIRTGKSSIMRSDAPIGTCSSECITPNGSIPNDKPFQNVNRITYGACPRY
VKQNTLKLATGMRNVPEKQTRGIFGAIAGFIENGWEGMVNGWYGFRHQNSEGTGQAADLKSTQAAIDQINGKLNRLI
EKTNEKFHQIEKEFSEVEGRIQDLEKYVEDTKIDLWSYNAELLVALENQHTIDLTDSEMNKLFEKTRKQLRENAEDM
GNGCFKIYHKCDNACIGSIRNGTYDHDVYRDEALNNRFQIKGVELKSGYKDWILWISFAISCFLLCVVLLGFIMWAC
QKGNIRCNICI

(11) H3N2-A/Hong Kong/1/1968

(SEQ ID NO: 95)
QDLPGNDNSTATLCLGHHAVPNGTLVKTITDDQIEVTNATELVQSSSTGKICNNPHRILDGIDCTLIDALLGDPHCD
VFQNETWDLFVERSKAFSNCYPYDVPDYASLRSLVASSGTLEFITEGFTWTGVTQNGGSNACKRGPGSGFFSRLNWL
TKSGSTYPVLNVTMPNNDNFDKLYIWGVHHPSTNQEQTSLYVQASGRVTVSTRRSQQTIIPNIGSRPWVRGLSSRIS
IYWTIVKPGDVLVINSNGNLIAPRGYFKMRTGKSSIMRSDAPIDTCISECITPNGSIPNDKPFQNVNKITYGACPKY
VKQNTLKLATGMRNVPEKQTRGLFGAIAGFIENGWEGMIDGWYGFRHQNSEGTGQAADLKSTQAAIDQINGKLNRVI
EKTNEKFHQIEKEFSEVEGRIQDLEKYVEDTKIDLWSYNAELLVALENQHTIDLTDSEMNKLFEKTRRQLRENAEDM
GNGCFKIYHKCDNACIESIRNGTYDHDVYRDEALNNRFQIKGVELKSGYKDWILWISFAISCFLLCVVLLGFIMWAC
QRGNIRCNICI

(12) H3N2-A/Perth/16/2009

(SEQ ID NO: 96)
QKLPGNDNSTATLCLGHHAVPNGTIVKTITNDQIEVTNATELVQSSSTGEICDSPHQILDGKNCTLIDALLGDPQCD
GFQNKKWDLFVERSKAYSNCYPYDVPDYASLRSLVASSGTLEFNNESFNWTGVTQNGTSSACIRRSKNSFFSRLNWL
THLNFKYPALNVTMPNNEQFDKLYIWGVHHPGTDKDQIFLYAQASGRITVSTKRSQQTVSPNIGSRPRVRNIPSRIS
IYWTIVKPGDILLINSTGNLIAPRGYFKIRSGKSSIMRSDAPIGKCNSECITPNGSIPNDKPFQNVNRITYGACPRY
VKQNTLKLATGMRNVPEKQTRGIFGAIAGFIENGWEGMVDGWYGFRHQNSEGRGQAADLKSTQAAIDQINGKLNRLI
GKTNEKFHQIEKEFSEVEGRIQDLEKYVEDTKIDLWSYNAELLVALENQHTIDLTDSEMNKLFEKTKKQLRENAEDM
GNGCFKIYHKCDNACIGSIRNGTYDHDVYRDEALNNRFQIKGVELKSGYKDWILWISFAISCFLLCVALLGFIMWAC
QKGNIRCNICI

(13) H3N2-A/Texas/06/2012

(SEQ ID NO: 97)
QKLPGNDNSTATLCLGHHAVPNGTIVKTITNDQIEVTNATELVQSSSTGEICNSPHQILDGENCTLIDALLGDPQCD
GFQNKKWDLFVERSKAHSNCYPYDVPDYASLRSLVASSGTLEFNNESFNWTGVTQNGTSSACIRRSNNSFFSRLNWL
THLNFKYPALNVTMPNNEQFDKLYIWGVHHPGTDKDQIFLYAQAAGRITVSTKRSQQAVIPNIGSRPRVRNIPSRVS
IYWTIVKPGDILLINSTGNLIAPRGYFKIRSGKSSIMRSDAPIGKCNSACITPNGSIPNDKPFQNVNRITYGACPRY
VKQNTLKLATGMRNVPEKQTRGIFGAIAGFIENGWEGMVDGWYGFRHQNSEGRGQAADLKSTQAAIDQINGKLNRLI
GKTNEKFHQIEKEFSEVEGRIQDLEKYVEDTKIDLWSYNAELLVALENQHTIDLTDSEMNKLFEKTKKQLRENAEDM
GNGCFKIYHKCDNACIGSIRNGTYDHDVYRDEALNNRFQIKGVELKSGYKDWILWISFAISCFLLCVALLGFIMWAC
QKGNIRCNICI

(14) H3N2-A/Wisconsin/67/2005

(SEQ ID NO: 98)
QKLPGNDNSTATLCLGHHAVPNGTIVKTITNDQIEVTNATELVQSSSTGGICDSPHQILDGENCTLIDALLGDPQCD
GFQNKKWDLFVERSKAYSNCYPYDVPDYASLRSLVASSGTLEFNDESFNWTGVTQNGTSSSCKRRSNNSFFSRLNWL
THLKFKYPALNVTMPNNEKFDKLYIWGVHHPVTDNDQIFLYAQASGRITVSTKRSQQTVIPNIGSRPRIRNIPSRIS
IYWTIVKPGDILLINSTGNLIAPRGYFKIRSGKSSIMRSDAPIGKCNSECITPNGSIPNDKPFQNVNRITYGACPRY

-continued

VKQNTLKLATGMRNVPEKQTRGIFGAIAGFIENGWEGMVDGWYGFRHQNSEGIGQAADLKSTQAAINQINGKLNRLI

GKTNEKFHQIEKEFSEVEGRIQDLEKYVEDTKIDLWSYNAELLVALENQHTIDLTDSEMNKLFERTKKQLRENAEDM

GNGCFKIYHKCDNACIGSIRNGTYDHDVYRDEALNNRFQIKGVELKSGYKDWILWISFAISCFLLCVALLGFIMWAC

QKGNIRCNICI

(15) H4N6-A/Duck/Czechoslovakia/1956

(SEQ ID NO: 99)

QNYTGNPVICMGHHAVANGTMVKTLADDQVEVVTAQELVESQNLPELCPSPLRLVDGQTCDIINGALGSPGCDHLNG

AEWDVFIERPNAVDTCYPFDVPEYQSLRSILANNGKFEFIAEEFQWNTVKQNGKSGACKRANVDDFFNRLNWLVKSD

GNAYPLQNLTKINNGDYARLYIWGVHHPSTSTEQTNLYKNNPGRVTVSTKTSQTSVVPDIGSRPLVRGQSGRVSFYW

TIVEPGDLIVFNTIGNLIAPRGHYKLNNQKKSTILNTAIPIGSCVSKCHTDKGSLSTTKPFQNISRIAVGDCPRYVK

QGSLKLATGMRNIPEKASRGLFGAIAGFIENGWQGLIDGWYGFRHQNAEGTGTAADLKSTQAAIDQINGKLNRLIEK

TNDKYHQIEKEFEQVEGRIQDLENYVEDTKIDLWSYNAELLVALENQHTIDVTDSEMNKLFERVRRQLRENAEDKGN

GCFEIFHKCDNNCIESIRNGTYDHDIYRDEAINNRFQIQGVKLTQGYKDIILWISFSISCFLLVALLLAFILWACQN

GNIRCQICI

(16) H5N1-A/Anhui/1/2005

(SEQ ID NO: 100)

DQICIGYHANNSTEQVDTIMEKNVTVTHAQDILEKTHNGKLCDLDGVKPLILRDCSVAGWLLGNPMCDEFINVPEWS

YIVEKANPANDLCYPGNFNDYEELKHLLSRINHFEKIQIIPKSSWSDHEASSGVSSACPYQGTPSFFRNVVWLIKKN

NTYPTIKRSYNNTNQEDLLILWGIHHSNDAAEQTKLYQNPTTYISVGTSTLNQRLVPKIATRSKVNGQSGRMDFFWT

ILKPNDAINFESNGNFIAPEYAYKIVKKGDSAIVKSEVEYGNCNTKCQTPIGAINSSMPFHNIHPLTIGECPKYVKS

NKLVLATGLRNSPLRERRRKRGLFGAIAGFIEGGWQGMVDGWYGYHHSNEQGSGYAADKESTQKAIDGVTNKVNSII

DKMNTQFEAVGREFNNLERRIENLNKKMEDGFLDVWTYNAELLVLMENERTLDFHDSNVKNLYDKVRLQLRDNAKEL

GNGCFEFYHKCDNECMESVRNGTYDYPQYSEEARLKREEISGVKLESIGTYQILSIYSTVASSLALAIMVAGLSLWM

CSNGSLQCRICI

(17) H5N1-A/chicken/Korea/es/2003

(SEQ ID NO: 101)

DQICIGYHANNSTEQVDTIMEKNVTVTHAQDILEKTHNGKLCDLDGVKPLILRDCSVAGWLLGNPMCDEFINVPEWS

YIVEKANPPNDLCYPGNFNDYEELKHLLSRINHFEKIQIIPKSSWSDHEASSGVSSACPYQGRSSFFRNVVWLIKKN

SAYPTIKRSYNNTNQEDLLVLWGIHHPNDAAEQTRLYQNPTTYISVGTSTLNQRLVPKIATRSKVNGQSGRMEFFWT

ILKPNDAISFESNGNFIAPEYAYKIVKKGDSAIMKSELEYGNCNTKCQTPMGAINSSMPFHNIHPLTIGECPKYVKS

SRLVLATGLRNSPQREKRKKRGLFGAIAGFIEGGWQGMVDGWYGYHHSNEQGSGYAADKESTQKAIDGVTNKVNSII

DKMNTQFEAVGREFNNLERRIENLNKKMEDGFLDVWTYNAELLVLMENERTLDFHDSNVKNLYDKVRLQLRDNAKEL

GNGCFEFYHRCDNECIESVRNGTYGYPQYSEEARLKREEISGVKLESIGTYQILSIYSTVASSLALAIMVAGLSLWM

CSNGSLQCRICI

(18) H5N1-A/Hong Kong/156/1997

(SEQ ID NO: 102)

DQICIGYHANNSTEQVDTIMEKNVTVTHAQDILERTHNGKLCDLNGVKPLILRDCSVAGWLLGNPMCDEFINVPEWS

YIVEKASPANDLCYPGNFNDYEELKHLLSRINHFEKIQIIPKSSWSNHDASSGVSSACPYLGRSSFFRNVVWLIKKN

SAYPTIKRSYNNTNQEDLLVLWGIHHPNDAAEQTKLYQNPTTYISVGTSTLNQRLVPEIATRPKVNGQSGRMEFFWT

ILKPNDAINFESNGNFIAPEYAYKIVKKGDSTIMKSELEYGNCNTKCQTPMGAINSSMPFHNIHPLTIGECPKYVKS

NRLVLATGLRNTPQRERRRKKRGLFGAIAGFIEGGWQGMVDGWYGYHHSNEQGSGYAADKESTQKAIDGVTNKVNSI

INKMNTQFEAVGREFNNLERRIENLNKKMEDGFLDVWTYNAELLVLMENERTLDFHDSNVKNLYDKVRLQLRDNAKE

LGNGCFEFYHKCDNECMESVKNGTYDYPQYSEEARLNREEISGVKLESMGTYQILSIYSTVASSLALAIMVAGLSLW

MCSNGSLQCRICI

(19) H5N1-A/Hong Kong/213/2003
(SEQ ID NO: 103)
DQICIGYHANNSTEQVDTIMEKNVTVTHAQDILEKTHNGKLCDLDGVKPLILRDCSVAGWLLGNPMCDEFINVPEWS

YIVEKANPANDLCYPGDFNDYEELKHLLSRINHFEKIQIIPKNSWSSHEASLGVSSACPYQGKSSFFRNVVWLIKKN

NAYPTIKRSYNNTNQEDLLVLWGIHHPNDAAEQTRLYQNPTTYISVGTSTLNQRLVPKIATRSKVNGQNGRMEFFWT

ILKPNDAINFESNGNFIAPEYAYKIVKKGDSAIMKSELEYGNCNTKCQTPMGAINSSMPFHNIHPLTIGECPKYVKS

NRLVLATGLRNSPQRERRRKKRGLFGAIAGFIEGGWQGMVDGWYGYHHSNEQGSGYAADKESTQKAIDGVTNKVNSI

IDKMNTQFEAVGREFNNLERRIENLNKKMEDGFLDVWTYNAELLVLMENERTLDFHDSNVKNLYDKVRLQLRDNAKE

LGNGCFEFYHKCDNECMESVRNGTYDYPQYSEEARLKREEISGVKLESIGTYQILSIYSTVASSLALAIMVAGLSLW

MCSNGSLQCRICI

(20) H5N1-A/Indonesia/05/2005
(SEQ ID NO: 104)
DQICIGYHANNSTEQVDTIMEKNVTVTHAQDILEKTHNGKLCDLDGVKPLILRDCSVAGWLLGNPMCDEFINVPEWS

YIVEKANPTNDLCYPGSFNDYEELKHLLSRINHFEKIQIIPKSSWSDHEASSGVSSACPYLGSPSFFRNVVWLIKKN

STYPTIKKSYNNTNQEDLLVLWGIHHPNDAAEQTRLYQNPTTYISIGTSTLNQRLVPKIATRSKVNGQSGRMEFFWT

ILKPNDAINFESNGNFIAPEYAYKIVKKGDSAIMKSELEYGNCNTKCQTPMGAINSSMPFHNIHPLTIGECPKYVKS

NRLVLATGLRNSPQRESRRKKRGLFGAIAGFIEGGWQGMVDGWYGYHHSNEQGSGYAADKESTQKAIDGVTNKVNSI

IDKMNTQFEAVGREFNNLERRIENLNKKMEDGFLDVWTYNAELLVLMENERTLDFHDSNVKNLYDKVRLQLRDNAKE

LGNGCFEFYHKCDNECMESIRNGTYNYPQYSEEARLKREEISGVKLESIGTYQILSIYSTVASSLALAIMMAGLSLW

MCSNGSLQCRICIK

(21) H5N1-A/turkey/Turkey/1/2005
(SEQ ID NO: 105)
DQICIGYHANNSTEQVDTIMEKNVTVTHAQDILEKTHNGKLCDLDGVKPLILRDCSVAGWLLGNPMCDEFLNVPEWS

YIVEKINPANDLCYPGNFNDYEELKHLLSRINHFEKIQIIPKSSWSDHEASAGVSSACPYQGRSSFFRNVVWLIKKD

NAYPTIKRSYNNTNQEDLLVLWGIHHPNDAAEQTRLYQNPTTYISVGTSTLNQRLVPKIATRSKVNGQSGRMEFFWT

ILKPNDAINFESNGNFIAPENAYKIVKKGDSTIMKSELEYGNCNTKCQTPIGAINSSMPFHNIHPLTIGECPKYVKS

SRLVLATGLRNSPQGERRRKKRGLFGAIAGFIEGGWQGMVDGWYGYHHSNEQGSGYAADKESTQKAIDGVTNKVNSI

IDKMNTQFEAVGREFNNLERRIENLNKKMEDGFLDVWTYNAELLVLMENERTLDFHDSNVKNLYDKVRLQLRDNAKE

LGNGCFEFYHRCDNECMESVRNGTYDYPQYSEEARLKREEISGVKLESIGTYQILSIYSTVASSLALAIMVAGLSLW

MCSNGSLQCRICI

(22) H5N1-A/Vietnam/1203/2004
(SEQ ID NO: 106)
DQICIGYHANNSTEQVDTIMEKNVTVTHAQDILEKTHNGKLCDLDGVKPLILRDCSVAGWLLGNPMCDEFINVPEWS

YIVEKANPVNDLCYPGDFNDYEELKHLLSRINHFEKIQIIPKSSWSSHEASLGVSSACPYQGKSSFFRNVVWLIKKN

STYPTIKRSYNNTNQEDLLVLWGIHHPNDAAEQTKLYQNPTTYISVGTSTLNQRLVPRIATRSKVNGQSGRMEFFWT

ILKPNDAINFESNGNFIAPEYAYKIVKKGDSTIMKSELEYGNCNTKCQTPMGAINSSMPFHNIHPLTIGECPKYVKS

NRLVLATGLRNSPQRERRRKKRGLFGAIAGFIEGGWQGMVDGWYGYHHSNEQGSGYAADKESTQKAIDGVTNKVNSI

IDKMNTQFEAVGREFNNLERRIENLNKKMEDGFLDVWTYNAELLVLMENERTLDFHDSNVKNLYDKVRLQLRDNAKE

LGNGCFEFYHKCDNECMESVRNGTYDYPQYSEEARLKREEISGVKLESIGIYQILSIYSTVASSLALAIMVAGLSLW

MCSNGSLQCR

(23) H5N1-A/whooper swan/Mongolia/244/2005
(SEQ ID NO: 107)
DQICIGYHANNSTEQVDTIMEKNVTVTHAQDILEKTHNGKLCDLDGVKPLILRDCSVAGWLLGNPMCDEFLNVPEWS

YIVEKINPANDLCYPGNFNDYEELKHLLSRINHFEKIQIIPKSSWSDHEASSGVSSACPYQGRSSFFRNVVWLIKKD

NAYPTIKRSYNNTNQEDLLVLWGIHHPNDAAEQTRLYQNPTTYISVGTSTLNQRLVPKIATRSKVNGQSGRMEFFWT

ILKPNDAINFESNGNFIAPENAYKIVKKGDSTIMKSELEYGNCNTKCQTPIGAINSSMPFHNIHPLTIGECPKYVKS

-continued

NRLVLATGLRNSPQGERRRRKRGLFGAIAGFIEGGWQGMVDGWYGYHHSNEQGSGYAADKESTQKAIDGVTNKVNSI

IDKMNTQFEAVGREFNNLERRIENLNKKMEDGFLDVWTYNAELLVLMENERTLDFHDSNVKNLYDKVRLQLRDNAKE

LGNGCFEFYHRCDNECMESVRNGTYDYPQYSEEARLKREEISGVKLESIGTYQILSIYSTVASSLALAIMVAGLSLW

MCSNGSLQCRICI

(24) H6N5-A/Shearwater/Australia/1972

(SEQ ID NO: 108)

DKICIGYHANNSTTQIDTILEKNVTVTHSVELLENQKEERFCKILKKAPLDLKGCTIEGWILGNPQCDLLLGDQSWS

YIVERPTAQNGICYPGVLNEVEELKALIGSGERVERFEMFPKSTWTGVDTSSGVTRACPYNSGSSFYRNLLWIIKTK

SAAYSVIKGAYNNTGNQPILYFWGVHHPPDTDEQNTLYGSGDRYVRMGTESMNFAKSPEIAARPAVNGQRGRIDYCW

SILKPGETLNVESNGNLIAPWYAFRFVSTSNKGAVFKSNLPIENCDATCQTVAGVLRTNKTFQNVSPLWIGECPKYV

KSESLRLATGLRNVPQIETRGLFGAIAGFIEGGWTGMIDGWYGYHHENSQGSGYAADRESTQKAVDGITNKVNSIID

KMNTQFEAVDHEFSNLERRIDNLNKRMEDGFLDVWTYNAELLVLLENERTLDLHDANVKNLYERVKSQLRDNAMILG

NGCFEFWHKCDDECMESVKNGTYDYPKYQDESKLNRQEIESVKLESLGVYQILAIYSTVSSSLVLVGLIIAVGLWMC

SNGSMQCRICI

(25) H7N1-A/chicken/Italy/4789/1999

(SEQ ID NO: 109)

DKICLGHHAVSNGTKVNTLTERGVEVVNATETVERTNVPRICSKGKRTVDLGQCGLLGTITGPPQCDQFLEFSADLI

IERREGSDVCYPGKFVNEEALRQILRESGGIDKEAMGFTYSGIRTNGTTSTCRRSGSSFYAEMKWLLSNTDNAAFPQ

MTKSYKNTRKDPALIIWGIHHSGSTTEQTKLYGSGNKLITVGSSNYQQSFVPSPGERPQVNGQSGRIDFHWLMLNPN

DTVTFSFNGAFIAPDRASFLRGKSMGIQSGVQVDANCEGDCYHSGGTIISNLPFQNINSRAVGKCPRYVKQESLLLA

TGMKNVPEIPKGSRVRRGLFGAIAGFIENGWEGLIDGWYGFRHQNAQGEGTAADYKSTQSAIDQVTGKLNRLIEKTN

QQFELIDNEFTEVEKQIGNVINWTRDSMTEVWSYNAELLVAMENQHTIDLTDSEMNKLYERVKRLLRENAEEDGTGC

FEIFHKCDDDCMASIRNNTYDHSKYREEAMQNRIQIDPVKLSSGYKDVILWFSFGASCFILLAIAMGLVFICVRNGN

MRCTICI

(26) H7N3-A/Canada/rv504/2004

(SEQ ID NO: 110)

DKICLGHHAVANGTKVNTLTERGIEVVNATETVETVNIKKICTQGKRPTDLGQCGLLGTLIGPPQCDQFLEFDANLI

IERREGTDVCYPGKFTNEESLRQILRGSGGIDKESMGFTYSGIRTNGATSACRRSGSSFYAEMKWLLSNSDNAAFPQ

MTKSYRNPRNKPALIIWGVHHSGSATEQTKLYGSGNKLITVGSSKYQQSFTPSPGARPQVNGQSGRIDFHWLLLDPN

DTVTFTFNGAFIAPDRASFFRGESLGVQSDVPLDSGCEGDCFHSGGTIVSSLPFQNINPRTVGKCPRYVKQTSLLLA

TGMRNVPENPKQAYQKRMTRGLFGAIAGFIENGWEGLIDGWYGFRHQNAQGEGTAADYKSTQSAIDQITGKLNRLID

KTNQQFELIDNEFSEIEQQIGNVINWTRDSMTEVWSYNAELLVAMENQHTIDLADSEMNKLYERVRKQLRENAEEDG

TGCFEIFHKCDDQCMESIRNNTYDHTQYRTESLQNRIQIDPVKLSSGYKDIILWFSFGASCFLLLAIAMGLVFICIK

NGNMRCTICI

(27) H7N7-A/Netherlands/219/2003

(SEQ ID NO: 112)

DKICLGHHAVSNGTKVNTLTERGVEVVNATETVERTNVPRICSKGKRTVDLGQCGLLGTITGPPQCDQFLEFSADLI

IERREGSDVCYPGKFVNEEALRQILRESGGIDKETMGFTYSGIRTNGTTSACRRSGSSFYAEMKWLLSNTDNAAFPQ

MTKSYKNTRKDPALIIWGIHHSGSTTEQTKLYGSGNKLITVGSSNYQQSFVPSPGARPQVNGQSGRIDFHWLILNPN

DTVTFSFNGAFIAPDRASFLRGKSMGIQSEVQVDANCEGDCYHSGGTIISNLPFQNINSRAVGKCPRYVKQESLLLA

TGMKNVPEIPKRRRRGLFGAIAGFIENGWEGLIDGWYGFRHQNAQGEGTAADYKSTQSAIDQITGKLNRLIEKTNQQ

FELIDNEFTEVERQIGNVINWTRDSMTEVWSYNAELLVAMENQHTIDLADSEMNKLYERVKRQLRENAEEDGTGCFE

IFHKCDDDCMASIRNNTYDHSKYREEAIQNRIQIDPVKLSSGYKDVILWFSFGASCFILLAIAMGLVFICVKNGNMR

CTICI

-continued

(28) H7N9-A/AnHui/1/2013
(SEQ ID NO: 113)
DKICLGHHAVSNGTKVNTLTERGVEVVNATETVERTNIPRICSKGKRTVDLGQCGLLGTITGPPQCDQFLEFSADLI

IERREGSDVCYPGKFVNEEALRQILRESGGIDKEAMGFTYSGIRTDGATSACRRSGSSFYAEMKWLLSNTDDAAFPQ

MTKSYKNTRKSPALIVWGIHHSVSTAEQTKLYGSGNKLVTVGSSNYQQSFVPSPGARPQVNGLSGRIDFHWLMLNPN

DTVTFSFNGAFIAPDRASFLRGKSMGIQSGVQVDANCEGDCYHSGGTIISNLPFQNIDSRAVGKCPRYVKQRSLLLA

TGMKNVPEIPKGRGLFGAIAGFIENGWEGLIDGWYGFRHQNAQGEGTAADYKSTQSAIDQITGKLNRLIEKTNQQFE

LIDNEFNEVEKQIGNVINWTRDSITEVWSYNAELLVAMENQHTIDLADSEMDKLYERVKRQLRENAEEDGTGCFEIF

HKCDDDCMASIRNNTYDHSKYREEAMQNRIQIDPVKLSSGYKDVILWFSFGASCFILLAIVMGLVFICVKNGNMRCT

ICI

(29) H9N2-A/Hong Kong/1073/1999

(SEQ ID NO: 114)

DKICIGHQSTNSTETVDTLTETNVPVTHAKELLHTEHNGMLCATSLGHPLILDTCTIEGLVYGNPSCDLLLGGREWS

YIVERSSAVNGTCYPGNVENLEELRTLFSSASSYQRIQIFPDTTWNVTYTGTSRACSGSFYRSMRWLTQKSGFYPVQ

DAQYTNNRGKSILFVWGIHHPPTYTEQTNLYIRNDTTTSVTTEDLNRTFKPVIGPRPLVNGLQGRIDYYWSVLKPGQ

TLRVRSNGNLIAPWYGHVLSGGSHGRILKTDLKGGNCVVQCQTEKGGLNSTLPFHNISKYAFGTCPKYVRVNSLKLA

VGLRNVPARSSRGLFGAIAGFIEGGWPGLVAGWYGFQHSNDQGVGMAADRDSTQKAIDKITSKVNNIVDKMNKQYEI

IDHEFSEVETRLNMINNKIDDQIQDVWAYNAELLVLLENQKTLDEHDANVNNLYNKVKRALGSNAMEDGKGCFELYH

KCDDQCMETIRNGTYNRRKYREESRLERQKIEGVKLESEGTYKILTIYSTVASSLVLAMGFAAFLFWAMSNGSCRCN

ICI

(30) H10N4-A/mink/Sweden/3900/1984

(SEQ ID NO: 115)

DKICLGHHAVANGTIVKTLTNVQEEVTNATETVESTSLNRLCMKGRSYKDLGNCHPIGMLIGTPACDLHLTGTWDTL

IERKNAIAYCYPGTTINEGALRQKIMESGGISKTSTGFAYGSSINSAGTTKACMRNGGDSFYAEVKWLVSKDKGQNF

PQTTNTYRNTDTAEHLIIWGIHHPSSTQEKNDLYGTQSLSISVGSSTYQNNFVPVVRARPQVNGQSGRIDFHWTLVQ

PGDNITFSHNGGRIAPSRVSKLVGRGLGIQSEASIDNGCESKCFWRGGSINTKLPFQNLSPRTVGQCPKYVNKKSLM

LATGMRNVPEIMQGRGLFGAIAGFIENGWEGMVDGWYGFRHQNAQGTGQAADYKSTQAAIDQITGKLNRLIEKTNTE

FESIESEFSEIEHQIGNVINWTKDSITDIWTYQAELLVAMENQHTIDMADSEMLNLYERVRKQLRQNAEEDGKGCFE

IYHTCDDSCMESIRNNTYDHSQYREEALLNRLNINSVKLSSGYKDIILWFSFGASCFVLLAAVMGLVFFCLKNGNMQ

CTICI

(31) H10N7-A/Chicken/Germany/n/1949

(SEQ ID NO: 116)

DKICLGHHAVANGTIVKTLTNVQEEVTNATETVESTSLNRLCMKGRSYKDLGNCHPIGMLIGTPACDLHLTGTWDTL

IERKNAIAYCYPGTTINEGALRQKIMESGGISKTSTGFAYGSSINSAGTTKACMRNGGDSFYAEVKWLVSKDKGQNF

PQTTNTYRNTDTAEHLIIWGIHHPSSTQEKNDLYGTQSLSISVGSSTYQNNFVPVVRARPQVNGQSGRIDFHWTLVQ

PGDNITFSHNGGRIAPSRVSKLVGRGLGIQSEASIDNGCESKCFWRGGSINTKLPFQNLSPRTVGQCPKYVNKKSLM

LATGMRNVPEIMQGRGLFGAIAGFIENGWEGMVDGWYGFRHQNAQGTGQAADYKSTQAAIDQITGKLNRLIEKTNTE

FESIESEFSEIEHQIGNVINWTKDSITDIWTYQAELLVAMENQHTIDMADSEMLNLYERVRKQLRQNAEEDGKGCFE

IYHTCDDSCMESIRNNTYDHSQYREEALLNRLNINSVKLSSGYKDIILWFSFGASCFVLLAAVMGLVFFCLKNGNMQ

CTICI

(32) H11N9-A/duck/Memphis/546/1974

(SEQ ID NO: 117)

DEICIGYLSNNSTEKVDTIIESNVTVTSSVELVENEYTGSFCSIDGKAPISLGDCSFAGWILGNPMCDDLIGKTSWS

YIVEKPNPINGICYPGTLENEEELRLKFSGVLEFNKFEAFTSNGWGSVNSGAGVTAACKFGSSNSFFRNMVWLIHQS

GTYPVIRRTFNNTKGRDVLMVWGVHHPATLKEHQDLYKKDNSYVAVGSESYNRRFTPEISTRPKVNGQAGRMTFYWT

IVKPEEAITFESNGAFLAPRYAFELVSLGNGKLFRSDLNIESCSTKCQSEIGWINTNRSFHSVHRNTIGDCPKYVNV

-continued

KSLKLATGLRNVPAIAARGLFGAIAGFIEGGWPGLINGWYGFQHRNEEGTGIAADKESTQTAIDQITSKVNNIVDRM

NTNFESVQHEFSEIEERINQLSKHVDDSVIDIWSYNAQLLVLLENEKTLDLHDSNVRNLHEKVRRMLKDNAKDEGNG

CFTFYHKCDNECIEKVRNGTYDHKEFEEESRLNRQEIEGVKLDSSGNVYKILSIYSCIASSLVLAAIIMGFIFWACS

NGSCRCTICI

(33) H12N5-A/Duck/Alberta/60/1976

(SEQ ID NO: 118)

DKICIGYQTNNSTETVNTLSEQNVPVTQVEELVHRGIDPILCGTELGSPLVLDDCSLEGLILGNPKCDLYLNGREWS

YIVERPKEMEGVCYPGSIENQEELRSLFSSIKKYERVKMFDFTKWNVTYTGTSKACNNTSNQGSFYRSMRWLTLKSG

QFPVQTDEYKNTRDSDIVFTWAIHHPPTSDEQVKLYKNPDTLSSVTTVEINRSFKPNIGPRPLVRGQQGRMDYYWAV

LKPGQTVKIQTNGNLIAPEYGHLITGKSHGRILKNNLPMGQCVTECQLNEGVMNTSKPFQNTSKHYIGKCPKYIPSG

SLKLAIGLRNVPQVQDRGLFGAIAGFIEGGWPGLVAGWYGFQHQNAEGTGIAADRDSTQRAIDNMQNKLNNVIDKMN

KQFEVVNHEFSEVESRINMINSKIDDQITDIWAYNAELLVLLENQKTLDEHDANVRNLHDRVRRVLRENAIDTGDGC

FEILHKCDNNCMDTIRNGTYNHKEYEEESKIERQKVNGVKLEENSTYKILSIYSSVASSLVLLLMIIGGFIFGCQNG

NVRCTFCI

(34) H13N6-A/Gull/Maryland/704/1977

(SEQ ID NO: 119)

DRICVGYLSTNSSERVDTLLENGVPVTSSIDLIETNHTGTYCSLNGVSPVHLGDCSFEGWIVGNPACTSNFGIREWS

YLIEDPAAPHGLCYPGELNNNGELRHLFSGIRSFSRTELIPPTSWGEVLDGTTSACRDNTGTNSFYRNLVWFIKKNN

RYPVISKTYNNTTGRDVLVLWGIHHPVSVDETKTLYVNSDPYTLVSTKSWSEKYKLETGVRPGYNGQRSWMKIYWSL

IHPGEMITFESNGGFLAPRYGYIIEEYGKGRIFQSRIRMSRCNTKCQTSVGGINTNRTFQNIDKNALGDCPKYIKSG

QLKLATGLRNVPAISNRGLFGAIAGFIEGGWPGLINGWYGFQHQNEQGTGIAADKESTQKAIDQITTKINNIIDKMN

GNYDSIRGEFNQVEKRINMLADRIDDAVTDIWSYNAKLLVLLENDKTLDMHDANVKNLHEQVRRELKDNAIDEGNGC

FELLHKCNDSCMETIRNGTYDHTEYAEESKLKRQEIDGIKLKSEDNVYKALSIYSCIASSVVLVGLILSFIMWACSS

GNCRFNVCI

(35) H14N5-A/Mallard/Astrakhan/263/1982

(SEQ ID NO: 120)

QITNGTTGNPIICLGHHAVENGTSVKTLTDNHVEVVSAKELVETNHTDELCPSPLKLVDGQDCHLINGALGSPGCDR

LQDTTWDVFIERPTAVDTCYPFDVPDYQSLRSILASSGSLEFIAEQFTWNGVKVDGSSSACLRGGRNSFFSRLNWLT

KATNGNYGPINVTKENTGSYVRLYLWGVHHPSSDNEQTDLYKVATGRVTVSTRSDQISIVPNIGSRPRVRNQSGRIS

IYWTLVNPGDSIIFNSIGNLIAPRGHYKISKSTKSTVLKSDKRIGSCTSPCLTDKGSIQSDKPFQNVSRIAIGNCPK

YVKQGSLMLATGMRNIPGKQAKGLFGAIAGFIENGWQGLIDGWYGFRHQNAEGTGTAADLKSTQAAIDQINGKLNRL

IEKTNEKYHQIEKEFEQVEGRIQDLEKYVEDTKIDLWSYNAELLVALENQHTIDVTDSEMNKLFERVRRQLRENAED

QGNGCFEIFHQCDNNCIESIRNGTYDHNIYRDEAINNRIKINPVTLTMGYKDIILWISFSMSCFVFVALILGFVLWA

CQNGNIRCQICI

(36) H15N9-A/shearwater/West Australia/2576/79

(SEQ ID NO: 121)

DKICLGHHAVANGTKVNTLTERGVEVVNATETVEITGIDKVCTKGKKAVDLGSCGILGTIIGPPQCDLHLEFKADLI

IERRNSSDICYPGRFTNEEALRQIIRESGGIDKESMGFRYSGIRTDGATSACKRTVSSFYSEMKWLSSSMNNQVFPQ

LNQTYRNTRKEPALIVWGVHHSSSLDEQNKLYGTGNKLITVGSSKYQQSFSPSPGARPKVNGQAGRIDFHWMLLDPG

DTVTFTFNGAFIAPDRATFLRSNAPSGIEYNGKSLGIQSDAQIDESCEGECFYSGGTINSPLPFQNIDSRAVGKCPR

YVKQSSLPLALGMKNVPEKIRTRGLFGAIAGFIENGWEGLIDGWYGFRHQNAQGQGTAADYKSTQAAIDQITGKLNR

LIEKTNKQFELIDNEFTEVEQQIGNVINWTRDSLTEIWSYNAELLVAMENQHTIDLADSEMNKLYERVRRQLRENAE

EDGTGCFEIFHRCDDQCMESIRNNTYNHTEYRQEALQNRIMINPVKLSSGYKDVILWFSFGASCVMLLAIAMGLIFM

CVKNGNLRCTICI

-continued

(37) H16N3-A/black-headed gull/Sweden/2/99
(SEQ ID NO: 122)
DKICIGYLSNNSTDTVDTLTENGVPVTSSIDLVETNHTGTYCSLNGVSPIHLGDCSFEGWIVGNPSCASNINIREWS

YLIEDPNAPHKLCFPGEVDNNGELRHLFSGVNSFSRTELIPPSKWGDILEGTTASCQNRGANSFYRNLIWLVNKLNK

YPVVKGEYNNTTGRDVLVLWGIHHPDTEATANKLYVNKNPYTLVSTKEWSRRYELEIGTRIGDGQRSWMKIYWHLMH

PGERITFESSGGLLAPRYGYIIEKYGTGRIFQSGVRLAKCNTKCQTSMGGINTNKTFQNIERNALGDCPKYIKSGQL

KLATGLRNVPSIVERGLFGAIAGFIEGGWPGLINGWYGFQHQNEQGTGIAADKTSTQKAINEITTKINNIIEKMNGN

YDSIRGEFNQVEKRINMIADRVDDAVTDIWSYNAKLLVLIENDRTLDLHDANVRNLHEQIKRALKDNAIDEGDGCFS

ILHKCNDSCMETIRNGTYNHEDYKEESQLKRQEIEGIKLKTEDNVYKILSIYSCIASSVVLVGLILAFILWACSSGN

CRFNVCI

(38) H17N10-A/little yellow-shouldered bat/Guatemala/060/2010
(SEQ ID NO: 123)
DRICIGYQANQNNQTVNTLLEQNVPVTGAQEILETNHNGKLCSLNGVPPLDLQSCTLAGWLLGNPNCDNLLEAEEWS

YIKINENAPDDLCFPGNFENLQDLLLEMSGVQNFTKVKLFNPQSMTGVTTNNVDQTCPFEGKPSFYRNLNWIQGNSG

LPFNIEIKNPTSNPLLLLWGIHNTKDAAQQRNLYGNDYSYTIFNFGEKSEEFRPDIGQRDEIKAHQDRIDYYWGSLP

AQSTLRIESTGNLIAPEYGFYYKRKEGKGGLMKSKLPISDCSTKCQTPLGALNSTLPFQNVHQQTIGNCPKYVKATS

LMLATGLRNNPQMEGRGLFGAIAGFIEGGWQGMIDGWYGYHHENQEGSGYAADKEATQKAVDAITNKVNSIIDKMNS

QFESNIKEFNRLELRIQHLSDRVDDALLDIWSYNTELLVLLENERTLDFHDANVKNLFEKVKAQLKDNAIDEGNGCF

LLLHKCNNSCMDDIKNGTYKYMDYREESHIEKQKIDGVKLTDYSRYYTMTLYSTIASSVVLGSLIIAAFLWGCQKGS

IQCKICI

(39) H18N11-A/flat-faced bat/Peru/033/2010
(SEQ ID NO: 124)
DQICIGYHSNNSTQTVNTLLESNVPVTSSHSILEKEHNGLLCKLKGKAPLDLIDCSLPAWLMGNPKCDELLTASEWA

YIKEDPEPENGICFPGDFDSLEDLILLVSNTDHFRKEKIIDMTRFSDVTTNNVDSACPYDTNGASFYRNLNWVQQNK

GKQLIFHYQNSENNPLLIIWGVHQTSNAAEQNTYYGSQTGSTTITIGEETNTYPLVISESSILNGHSDRINYFWGVV

NPNQNFSIVSTGNFIWPEYGYFFQKTTNISGIIKSSEKISDCDTICQTKIGAINSTLPFQNIHQNAIGDCPKYVKAQ

ELVLATGLRNNPIKETRGLFGAIAGFIEGGWQGLIDGWYGYHHQNSEGSGYAADKEATQKAVDAITTKVNNIIDKMN

TQFESTAKEFNKIEMRIKHLSDRVDDGFLDVWSYNAELLVLLENERTLDFHDANVNNLYQKVKVQLKDNAIDMGNGC

FKILHKCNNTCMDDIKNGTYNYYEYRKESHLEKQKIDGVKLSENSSYKIMIIYSTVASSVVLGLIILAAIEWGCFKG

NLQCRICI

(40) Influenza B virus (B/Texas/06/2011)
(SEQ ID NO: 125)
DRICTGITSSNSPHVVKTATQGEVNVTGVIPLTTTPTKSYFANLKGTRTRGKLCPDCLNCTDLDVALGRPMCVGTTP

SAKASILHEVRPVTSGCFPIMHDRTKIRQLPNLLRGYENIRLSTQNVIDAEKAPGGPYRLGTSGSCPNATSKIGFFA

TMAWAVPKDNYKNATNPLTVEVPYICKEEEDQITVWGFHSDNKTQMKNLYGDSNPQKFTSSANGVTTHYVSQIGDFP

DQTEDGGLPQSGRIVVDYMMQKPGKTGTIVYQRGVLLPQKVWCASGRSKVIKGSLPLIGEADCLHEKYGGLNKSKPY

YTGEHAKAIGNCPIWVKTPLKLANGTKYRPPAKLLKERGFFGAIAGFLEGGWEGMIAGWHGYTSHGAHGVAVAADLK

STQEAINKITKNLNSLSELEVKNLQRLSGAMDELHNEILELDEKVDDLRADTISSQIELAVLLSNEGIINSEDEHLL

ALERKLKKMLGPSAVDIGNGCFETKHKCNQTCLDRIAAGTFNAGEFSLPTFDSLNITAASLNDDGLDNHTILLYYST

AASSLAVTLMLAIFIVYMVSRDNVSCSICL

(41) Influenza B virus (B/Wisconsin/01/2012)
(SEQ ID NO: 126)
DRICTGITSSNSPHVVKTATQGEVNVTGVIPLTTTPTKSHFANLKGTETRGKLCPKCLNCTDLDVALGRPKCTGKIP

SARVSILHEVRPVTSGCFPIMHDRTKIRQLPNLLRGYEHIRLSTHNVINAENAPGGPYKIGTSGSCPNVTNGNGFFA

TMAWAVPKNDKNKTATNPLTIEVPYICTEGEDQITVWGFHSDNETQMAKLYGDSKPQKFTSSANGVTTHYVSQIGGF

PNQTEDGGLPQSGRIVVDYMVQKSGKTGTITYQRGILLPQKVWCASGRSKVIKGSLPLIGEADCLHEKYGGLNKSKP

-continued

YYTGEHAKAIGNCPIWVKTPLKLANGTKYRPPAKLLKERGFFGAIAGFLEGGWEGMIAGWHGYTSHGAHGVAVAADL

KSTQEAINKITKNLNSLSELEVKNLQRLSGAMDELHNEILELDEKVDDLRADTISSQIELAVLLSNEGIINSEDEHL

LALERKLKKMLGPSAVEIGNGCFETKHKCNQTCLDRIAAGTFDAGEFSLPTFDSLNITAASLNDDGLDNHTILLYYS

TAASSLAVTLMIAIFVVYMVSRDNVSCSICL

(42) Influenza B virus (B/Massachusetts/02/2012)
(SEQ ID NO: 127)
DRICTGITSSNSPHVVKTATQGEVNVTGVIPLTTTPTKSYFANLKGTKTRGKLCPDCLNCTDLDVALGRPMCVGTTP

SAKASILHEVRPVTSGCFPIMHDRTKIRQLANLLRGYENIRLSTQNVIDAEKAPGGPYRLGTSGSCPNATSKSGFFA

TMAWAVPKDNNKNATNPLTVEVPYICAEGEDQITVWGFHSDDKTQMKNLYGDSNPQKFTSSANGVTTHYVSQIGGFP

DQTEDGGLPQSGRIVVDYMMQKPGKTGTIVYQRGVLLPQKVWCASGRSKVIKGSLPLIGEADCLHEKYGGLNKSKPY

YTGEHAKAIGNCPIWVKTPLKLANGTKYRPPAKLLKERGFFGAIAGFLEGGWEGMIAGWHGYTSHGAHGVAVAADLK

STQEAINKITKNLNSLSELEVKNLQRLSGAMDELHNEILELDEKVDDLRADTISSQIELAVLLSNEGIINSEDEHLL

ALERKLKKMLGPSAVDIGNGCFETKHKCNQTCLDRIAAGTFNAGEFSLPTFDSLNITAASLNDDGLDNHTILLYYST

AASSLAVTLMLAIFIVYMVSRDNVSCSICL

(43) Influenza B virus (B/Florida/4/2006)
(SEQ ID NO: 128)
DRICTGITSSNSPHVVKTATQGEVNVTGVIPLTTTPTKSYFANLKGTRTRGKLCPDCLNCTDLDVALGRPMCVGTTP

SAKASILHEVKPVTSGCFPIMHDRTKIRQLPNLLRGYENIRLSTQNVIDAEKAPGGPYRLGTSGSCPNATSKSGFFA

TMAWAVPKDNNKNATNPLTVEVPYICTEGEDQITVWGFHSDDKTQMKNLYGDSNPQKFTSSANGVTTHYVSQIGSFP

DQTEDGGLPQSGRIVVDYMMQKPGKTGTIVYQRGVLLPQKVWCASGRSKVIKGSLPLIGEADCLHEKYGGLNKSKPY

YTGEHAKAIGNCPIWVKTPLKLANGTKYRPPAKLLKERGFFGAIAGFLEGGWEGMIAGWHGYTSHGAHGVAVAADLK

STQEAINKITKNLNSLSELEVKNLQRLSGAMDELHNEILELDEKVDDLRADTISSQIELAVLLSNEGIINSEDEHLL

ALERKLKKMLGPSAVEIGNGCFETKHKCNQTCLDRIAAGTFNAGEFSLPTFDSLNITAASLNDDGLDNHTILLYYST

AASSLAVTLMLAIFIVYMVSRDNVSCSICL

The ectodomain of any of the above influenza HA sequences can be included on a recombinant insect ferritin heavy or light chain fusion protein as described herein to generate a recombinant insect ferritin nanoparticle including the influenza HA ectodomain in trimeric form. In some embodiments the influenza HA ectodomain comprises a HA1 polypeptide and a HA2 ectodomain including amino acid sequences having at least 75% (for example at least 85%, 90%, 95%, 96%, 97%, 98% or 99%) sequence identity to a corresponding native HA' or HA2 ectodomain polypeptide sequence, such a native influenza HA sequence set forth above. In the recombinant insect ferritin nanoparticle, the signal peptide of the influenza HA ectodomain is typically not included as this sequence is removed by proteolytic processing when the ectodomain is expressed in a cell.

The influenza HA ectodomain included on the recombinant insect ferritin nanoparticle can include one or more modifications from a native influenza HA protein sequence that has been determined to stabilize the HA protein in a conformation that induces production of neutralizing antibodies when administered to a subject, for example neutralizing antibodies that specifically bind the HA stem region.

The recombinant influenza HA ectodomain trimer typically includes a protein complex of HA1-HA2 ectodomain protomers. The HA1-HA2 protomer comprises separate HA' and HA2 polypeptide chains, or comprises HA' and HA2 polypeptide chains that are linked (e.g., by a peptide linker) to form a single polypeptide chain (a "single chain" influenza HA ectodomain).

The HA1 polypeptide included on a purified recombinant insect ferritin nanoparticle typically does not include a signal peptide, as the signal peptide is proteolytically cleaved during cellular processing. Additionally, the HA2 ectodomain includes the extracellular portion of HA2 (the ectodomain), but not the transmembrane domain or cytoplasmic tail. Thus, in the case of Influenza A and B strains, 45 to 55 C-terminal residues would not be included in the sequence added to the insect Ferritin sequence i.e. for H3N2-A/Hong Kong/1/1968 the HA portion of the construct would end at residue 519 and not include VELKSGYKD-WILWISFAISCFLLCVVLLGFIMWACQRGNIRCNICI (residues 505-550 of SEQ ID NO: 93) while in the case of Influenza B virus (B/Florida/4/2006) the HA portion of the construct would end at residue 535 and would not include the C-terminal ASLNDDGLDNHTILLYYS-TAASSLAVTLMLAIFIVYMVSRDNVSCSICL (residues 521-569 of SEQ ID NO: 125) sequence. In some examples of Influenza A strains, the construct can be truncated at residue 513; in others, it can be truncated at residue 518 or 519. In the case of Influenza B strains, in some embodiments, the construct can be truncated at residue 534.

In some embodiments, the insect ferritin nanoparticle comprises an insect ferritin light chain (e.g., SEQ ID NO: 6) fused to the ectodomain of any of the above influenza HA proteins. In some embodiments, the insect ferritin nanoparticle comprises an insect ferritin heavy chain (e.g., SEQ ID NO: 2) fused to the ectodomain of any of the above influenza HA proteins. In some embodiments, the insect ferritin nanoparticle comprises an insect ferritin light chain (e.g., SEQ ID NO: 6) fused to the ectodomain of any of the above influenza HA proteins, and an insect ferritin heavy chain (e.g., SEQ ID NO: 2) fused to the ectodomain of any of the remaining influenza HA proteins listed above. For example, in some embodiments, the insect ferritin nanoparticle comprises an insect ferritin light chain (e.g., SEQ ID NO: 6) and an insect ferritin heavy chain (e.g., SEQ ID NO: 2), or an insect ferritin heavy chain (e.g., SEQ ID NO: 2) and an insect ferritin light chain (e.g., SEQ ID NO: 6), respectively fused to the ectodomains of any one of the following pairs of influenza HA proteins: (1) and (2), (1) and (3), (1) and (4), (1) and (5), (1) and (6), (1) and (7), (1) and (8), (1) and (9), (1) and (10), (1) and (11), (1) and (12), (1) and (13), (1) and (14), (1) and (15), (1) and (16), (1) and (17), (1) and (18), (1) and (19), (1) and (20), (1) and (21), (1) and (22), (1) and (23), (1) and (24), (1) and (25), (1) and (26), (1) and (27), (1) and (28), (1) and (29), (1) and (30), (1) and (31), (1) and (32), (1) and (33), (1) and (34), (1) and (35), (1) and (36), (1) and (37), (1) and (38), (1) and (39), (1) and (40), (1) and (41), (1) and (42), (1) and (43), (2) and (3), (2) and (4), (2) and (5), (2) and (6), (2) and (7), (2) and (8), (2) and (9), (2) and (10), (2) and (11), (2) and (12), (2) and (13), (2) and (14), (2) and (15), (2) and (16), (2) and (17), (2) and (18), (2) and (19), (2) and (20), (2) and (21), (2) and (22), (2) and (23), (2) and (24), (2) and (25), (2) and (26), (2) and (27), (2) and (28), (2) and (29), (2) and (30), (2) and (31), (2) and (32), (2) and (33), (2) and (34), (2) and (35), (2) and (36), (2) and (37), (2) and (38), (2) and (39), (2) and (40), (2) and (41), (2) and (42), (2) and (43), (3) and (4), (3) and (5), (3) and (6), (3) and (7), (3) and (8), (3) and (9), (3) and (10), (3) and (11), (3) and (12), (3) and (13), (3) and (14), (3) and (15), (3) and (16), (3) and (17), (3) and (18), (3) and (19), (3) and (20), (3) and (21), (3) and (22), (3) and (23), (3) and (24), (3) and (25), (3) and (26), (3) and (27), (3) and (28), (3) and (29), (3) and (30), (3) and (31), (3) and (32), (3) and (33), (3) and (34), (3) and (35), (3) and (36), (3) and (37), (3) and (38), (3) and (39), (3) and (40), (3) and (41), (3) and (42), (3) and (43), (4) and (5), (4) and (6), (4) and (7), (4) and (8), (4) and (9), (4) and (10), (4) and (11), (4) and (12), (4) and (13), (4) and (14), (4) and (15), (4) and (16), (4) and (17), (4) and (18), (4) and (19), (4) and (20), (4) and (21), (4) and (22), (4) and (23), (4) and (24), (4) and (25), (4) and (26), (4) and (27), (4) and (28), (4) and (29), (4) and (30), (4) and (31), (4) and (32), (4) and (33), (4) and (34), (4) and (35), (4) and (36), (4) and (37), (4) and (38), (4) and (39), (4) and (40), (4) and (41), (4) and (42), (4) and (43), (5) and (6), (5) and (7), (5) and (8), (5) and (9), (5) and (10), (5) and (11), (5) and (12), (5) and (13), (5) and (14), (5) and (15), (5) and (16), (5) and (17), (5) and (18), (5) and (19), (5) and (20), (5) and (21), (5) and (22), (5) and (23), (5) and (24), (5) and (25), (5) and (26), (5) and (27), (5) and (28), (5) and (29), (5) and (30), (5) and (31), (5) and (32), (5) and (33), (5) and (34), (5) and (35), (5) and (36), (5) and (37), (5) and (38), (5) and (39), (5) and (40), (5) and (41), (5) and (42), (5) and (43), (6) and (7), (6) and (8), (6) and (9), (6) and (10), (6) and (11), (6) and (12), (6) and (13), (6) and (14), (6) and (15), (6) and (16), (6) and (17), (6) and (18), (6) and (19), (6) and (20), (6) and (21), (6) and (22), (6) and (23), (6) and (24), (6) and (25), (6) and (26), (6) and (27), (6) and (28), (6) and (29), (6) and (30), (6) and (31), (6) and (32), (6) and (33), (6) and (34), (6) and (35), (6) and (36), (6) and (37), (6) and (38), (6) and (39), (6) and (40), (6) and (41), (6) and (42), (6) and (43), (7) and (8), (7) and (9), (7) and (10), (7) and (11), (7) and (12), (7) and (13), (7) and (14), (7) and (15), (7) and (16), (7) and (17), (7) and (18), (7) and (19), (7) and (20), (7) and (21), (7) and (22), (7) and (23), (7) and (24), (7) and (25), (7) and (26), (7) and (27), (7) and (28), (7) and (29), (7) and (30), (7) and (31), (7) and (32), (7) and (33), (7) and (34), (7) and (35), (7) and (36), (7) and (37), (7) and (38), (7) and (39), (7) and (40), (7) and (41), (7) and (42), (7) and (43), (8) and (9), (8) and (10), (8) and (11), (8) and (12), (8) and (13), (8) and (14), (8) and (15), (8) and (16), (8) and (17), (8) and (18), (8) and (19), (8) and (20), (8) and (21), (8) and (22), (8) and (23), (8) and (24), (8) and (25), (8) and (26), (8) and (27), (8) and (28), (8) and (29), (8) and (30), (8) and (31), (8) and (32), (8) and (33), (8) and (34), (8) and (35), (8) and (36), (8) and (37), (8) and (38), (8) and (39), (8) and (40), (8) and (41), (8) and (42), (8) and (43), (9) and (10), (9) and (11), (9) and (12), (9) and (13), (9) and (14), (9) and (15), (9) and (16), (9) and (17), (9) and (18), (9) and (19), (9) and (20), (9) and (21), (9) and (22), (9) and (23), (9) and (24), (9) and (25), (9) and (26), (9) and (27), (9) and (28), (9) and (29), (9) and (30), (9) and (31), (9) and (32), (9) and (33), (9) and (34), (9) and (35), (9) and (36), (9) and (37), (9) and (38), (9) and (39), (9) and (40), (9) and (41), (9) and (42), (9) and (43), (10) and (11), (10) and (12), (10) and (13), (10) and (14), (10) and (15), (10) and (16), (10) and (17), (10) and (18), (10) and (19), (10) and (20), (10) and (21), (10) and (22), (10) and (23), (10) and (24), (10) and (25), (10) and (26), (10) and (27), (10) and (28), (10) and (29), (10) and (30), (10) and (31), (10) and (32), (10) and (33), (10) and (34), (10) and (35), (10) and (36), (10) and (37), (10) and (38), (10) and (39), (10) and (40), (10) and (41), (10) and (42), (10) and (43), (11) and (12), (11) and (13), (11) and (14), (11) and (15), (11) and (16), (11) and (17), (11) and (18), (11) and (19), (11) and (20), (11) and (21), (11) and (22), (11) and (23), (11) and (24), (11) and (25), (11) and (26), (11) and (27), (11) and (28), (11) and (29), (11) and (30), (11) and (31), (11) and (32), (11) and (33), (11) and (34), (11) and (35), (11) and (36), (11) and (37), (11) and (38), (11) and (39), (11) and (40), (11) and (41), (11) and (42), (11) and (43), (12) and (13), (12) and (14), (12) and (15), (12) and (16), (12) and (17), (12) and (18), (12) and (19), (12) and (20), (12) and (21), (12) and (22), (12) and (23), (12) and (24), (12) and (25), (12) and (26), (12) and (27), (12) and (28), (12) and (29), (12) and (30), (12) and (31), (12) and (32), (12) and (33), (12) and (34), (12) and (35), (12) and (36), (12) and (37), (12) and (38), (12) and (39), (12) and (40), (12) and (41), (12) and (42), (12) and (43), (13) and (14), (13) and (15), (13) and (16), (13) and (17), (13) and (18), (13) and (19), (13) and (20), (13) and (21), (13) and (22), (13) and (23), (13) and (24), (13) and (25), (13) and (26), (13) and (27), (13) and (28), (13) and (29), (13) and (30), (13) and (31), (13) and (32), (13) and (33), (13) and (34), (13) and (35), (13) and (36), (13) and (37), (13) and (38), (13) and (39), (13) and (40), (13) and (41), (13) and (42), (13) and (43), (14) and (15), (14) and (16), (14) and (17), (14) and (18), (14) and (19), (14) and (20), (14) and (21), (14) and (22), (14) and (23), (14) and (24), (14) and (25), (14) and (26), (14) and (27), (14) and (28), (14) and (29), (14) and (30), (14) and (31), (14) and (32), (14) and (33), (14) and (34), (14) and (35), (14) and (36), (14) and (37), (14) and (38), (14) and (39), (14) and (40), (14) and (41), (14) and (42), (14) and (43), (15) and (16), (15) and (17), (15) and (18), (15) and (19), (15) and (20), (15) and (21), (15) and (22), (15) and (23), (15) and (24), (15) and (25), (15) and (26), (15) and (27), (15) and (28), (15) and (29), (15) and (30), (15) and (31), (15) and (32), (15) and (33), (15) and (34), (15) and (35), (15) and (36), (15) and (37), (15) and (38), (15) and (39), (15) and (40), (15) and (41), (15) and (42), (15) and (43), (16) and (17), (16) and (18), (16) and (19), (16) and (20), (16) and (21), (16) and (22), (16) and (23), (16) and (24), (16) and (25), (16) and (26), (16) and (27), (16) and (28), (16) and (29), (16) and (30), (16) and (31), (16) and (32), (16) and (33), (16) and (34), (16) and (35), (16) and (36), (16) and (37), (16) and (38), (16) and (39), (16) and (40), (16) and (41), (16) and (42), (16) and (43), (17) and (18), (17) and (19), (17) and (20), (17) and (21), (17) and (22), (17) and (23), (17) and (24), (17) and (25), (17) and (26), (17) and (27), (17) and (28), (17) and (29), (17) and (30), (17) and (31), (17) and (32), (17) and (33), (17) and (34), (17) and (35), (17) and (36), (17) and (37), (17) and (38), (17) and (39), (17) and (40), (17) and (41), (17) and (42), (17) and (43), (18) and (19), (18) and (20), (18) and (21), (18) and (22), (18) and (23), (18) and (24), (18) and (25), (18) and (26), (18) and (27), (18) and (28), (18) and (29), (18) and (30), (18) and (31), (18) and (32), (18) and (33), (18) and (34), (18) and (35), (18) and (36), (18) and (37), (18) and (38), (18) and (39), (18) and (40), (18) and (41), (18) and (42), (18) and (43), (19) and (20), (19) and (21), (19) and (22), (19) and (23), (19) and (24), (19) and (25), (19) and (26), (19) and (27), (19) and (28), (19) and (29), (19) and (30), (19) and (31), (19) and (32), (19) and (33), (19) and (34), (19) and (35), (19) and (36), (19) and (37), (19) and (38), (19) and (39), (19) and (40), (19) and (41), (19) and (42), (19) and (43), (20) and (21), (20) and (22), (20) and (23), (20) and (24), (20) and (25), (20) and (26), (20) and (27), (20) and (28), (20) and (29), (20) and (30), (20) and (31), (20) and (32), (20) and (33), (20) and (34), (20) and (35), (20) and (36), (20) and (37), (20) and (38), (20) and (39), (20) and (40), (20) and (41), (20) and (42), (20) and (43), (21) and (22), (21) and (23), (21) and (24), (21) and (25), (21) and (26), (21) and (27), (21) and (28), (21) and (29), (21) and (30), (21) and (31), (21) and (32), (21) and (33), (21) and (34), (21) and (35), (21) and (36), (21) and (37), (21) and (38), (21) and (39), (21) and (40), (21) and (41), (21) and (42), (21) and (43), (22) and (23), (22) and (24), (22) and (25), (22) and (26), (22) and (27), (22) and (28), (22) and (29), (22) and (30), (22) and (31), (22) and (32), (22) and (33), (22) and (34), (22) and (35), (22) and (36), (22) and (37), (22) and (38), (22) and (39), (22) and (40), (22) and (41), (22) and (42), (22) and (43), (23) and (24), (23) and (25), (23) and (26), (23) and (27), (23) and (28), (23) and (29), (23) and (30), (23) and (31), (23) and (32), (23) and (33), (23) and (34), (23) and (35), (23) and (36), (23) and (37), (23) and (38), (23) and (39), (23) and (40), (23) and (41), (23) and (42), (23) and (43), (24) and (25), (24) and (26), (24) and (27), (24) and (28), (24) and (29), (24) and (30), (24) and (31), (24) and (32), (24) and (33), (24) and (34), (24) and (35), (24) and (36), (24) and (37), (24) and (38), (24) and (39), (24) and (40), (24) and (41), (24) and (42), (24) and (43), (25) and (26), (25) and (27), (25) and (28), (25) and (29), (25) and (30), (25) and (31), (25) and (32), (25) and (33), (25) and (34), (25) and (35), (25) and (36), (25) and (37), (25) and (38), (25) and (39), (25) and (40), (25) and (41), (25) and (42), (25) and (43), (26) and (27), (26) and (28), (26) and (29), (26) and (30), (26) and (31), (26) and (32), (26) and (33), (26) and (34), (26) and (35), (26) and (36), (26) and (37), (26) and (38), (26) and (39), (26) and (40), (26) and (41), (26) and (42), (26) and (43), (27) and (28), (27) and (29), (27) and (30), (27) and (31), (27) and (32), (27) and (33), (27) and (34), (27) and (35), (27) and (36), (27) and (37), (27) and (38), (27) and (39), (27) and (40), (27) and (41), (27) and (42), (27) and (43), (28) and (29), (28) and (30), (28) and (31), (28) and (32), (28) and (33), (28) and (34), (28) and (35), (28) and (36), (28) and (37), (28) and (38), (28) and (39), (28) and (40), (28) and (41), (28) and (42), (28) and (43), (29) and (30), (29) and (31), (29) and (32), (29) and (33), (29) and (34), (29) and (35), (29) and (36), (29) and (37), (29) and (38), (29) and (39), (29) and (40), (29) and (41), (29) and (42), (29) and (43), (30) and (31), (30) and (32), (30) and (33), (30) and (34), (30) and (35), (30) and (36), (30) and (37), (30) and (38), (30) and (39), (30) and (40), (30) and (41), (30) and (42), (30) and (43), (31) and (32), (31) and (33), (31) and (34), (31) and (35), (31) and (36), (31) and (37), (31) and (38), (31) and (39), (31) and (40), (31) and (41), (31) and (42), (31) and (43), (32) and (33), (32) and (34), (32) and (35), (32) and (36), (32) and (37), (32) and (38), (32) and (39), (32) and (40), (32) and (41), (32) and (42), (32) and (43), (33) and (34), (33) and (35), (33) and (36), (33) and (37), (33) and (38), (33) and (39), (33) and (40), (33) and (41), (33) and (42), (33) and (43), (34) and (35), (34) and (36), (34) and (37), (34) and (38), (34) and (39), (34) and (40), (34) and (41), (34) and (42), (34) and (43), (35) and (36), (35) and (37), (35) and (38), (35) and (39), (35) and (40), (35) and (41), (35) and (42), (35) and (43), (36) and (37), (36) and (38), (36) and (39), (36) and (40), (36) and (41), (36) and (42), (36) and (43), (37) and (38), (37) and (39), (37) and (40), (37) and (41), (37) and (42), (37) and (43), (38) and (39), (38) and (40), (38) and (41), (38) and (42), (38) and (43), (39) and (40), (39) and (41), (39) and (42), (39) and (43), (40) and (41), (40) and (42), (40) and (43), (41) and (42), (41) and (43), or (42) and (43). In the above pairings of influenza HA proteins, the number in parentheses refers to the influenza HA proteins listed in this section, for example reference to "(1)" refers to "(1) H1N1-A/Brevig Mission/1/1918" as shown above.

Sequences of exemplary insect ferritin heavy and light chain fusion proteins including heavy or light chain ferritin subunits fused to influenza HA ectodomains are provided below:

```
H1CA_HA(518)_5ln_iFerr(H)
                                                            (SEQ ID NO: 129)
DTLCIGYHANNSTDTVDTVLEKNVTVTHSVNLLEDKHNGKLCKLRGVAPLHLGKCNIAGWILGNPECESLSTASSWS

YIVETPSSDNGTCYPGDFIDYEELREQLSSVSSFERFEIFPKTSSWPNHDSNKGVTAACPHAGAKSFYKNLIWLVKK

GNSYPKLSKSYINDKGKEVLVLWGIHHPSTSADQQSLYQNADTYVFVGSSRYSKKFKPEIAIRPKVRDQEGRMNYYW

TLVEPGDKITFEATGNLVVPRYAFAMERNAGSGIIISDTPVHDCNTTCQTPKGAINTSLPFQNIHPITIGKCPKYVK

STKLRLATGLRNIPSIQSRGLFGAIAGFIEGGWTGMVDGWYGYHHQNEQGSGYAADLKSTQNAIDEITNKVNSVIEK

MNTQFTAVGKEFNHLEKRIENLNKKVDDGFLDIWTYNAELLVLLENERTLDYHDSNVKNLYEKVRSQLKNNAKEIGN

GCFEFYHKCDNTCMESVKNGTYDYPKYSEEAKLNREEIDggsggRSCRNSMRQQIQMEVGASLQYLAMGAHFSKDVV
```

-continued

NRPGFAQLFFDAASEEREHAMKLIEYLLMRGELTNDVSSLLQVRPPTRSSWKGGVEALEHALSMESDVTKSIRNVIK

ACEDDSEFNDYHLVDYLTGDFLEEQYKGQRDLAGKASTLKKLMDRHEALGEFIFDKKLLGIDV

H7AnhuiHA_5ln_iFerr(H)

(SEQ ID NO: 130)

DKICLGHHAVSNGTKVNTLTERGVEVVNATETVERTNIPRICSKGKRTVDLGQCGLLGTITGPPQCDQFLEFSADLI

IERREGSDVCYPGKFVNEEALRQILRESGGIDKEAMGFTYSGIRTNGATSACRRSGSSFYAEMKWLLSNTDNAAFPQ

MTKSYKNTRKSPALIVWGIHHSVSTAEQTKLYGSGNKLVTVGSSNYQQSFVPSPGARPQVNGLSGRIDFHWLMLNPN

DTVTFSFNGAFIAPDRASFLRGKSMGIQSGVQVDANCEGDCYHSGGTIISNLPFQNIDSRAVGKCPRYVKQRSLLLA

TGMKNVPEIPKGRGLFGAIAGFIENGWEGLIDGWYGFRHQNAQGEGTAADYKSTQSAIDQITGKLNRLIEKTNQQFE

LIDNEFNEVEKQIGNVINWTRDSITEVWSYNAELLVAMENQHTIDLADSEMDKLYERVKRQLRENAEEDGTGCFEIF

HKCDDDCMASIRNNTYDHSKYREEAMQNRIQIDggsggRSCRNSMRQQIQMEVGASLQYLAMGAHFSKDVVNRPGFA

QLFFDAASEEREHAMKLIEYLLMRGELTNDVSSLLQVRPPTRSSWKGGVEALEHALSMESDVTKSIRNVIKACEDDS

EFNDYHLVDYLTGDFLEEQYKGQRDLAGKASTLKKLMDRHEALGEFIFDKKLLGIDV

A/California/07/2009(H1N1)_5ln_iFerr(H)

(SEQ ID NO: 131)

DTLCIGYHANNSTDTVDTVLEKNVTVTHSVNLLEDKHNGKLCKLRGVAPLHLGKCNIAGWILGNPECESLSTASSWS

YIVETPSSDNGTCYPGDFIDYEELREQLSSVSSFERFEIFPKTSSWPNHDSNKGVTAACPHAGAKSFYKNLIWLVKK

GNSYPKLSKSYINDKGKEVLVLWGIHHPSTSADQQSLYQNADAYVFVGSSRYSKKFKPEIAIRPKVRDREGRMNYYW

TLVEPGDKITFEATGNLVVPRYAFAMERNAGSGIIISDTPVHDCNTTCQTPKGAINTSLPFQNIHPITIGKCPKYVK

STKLRLATGLRNIPSIQSRGLFGAIAGFIEGGWTGMVDGWYGYHHQNEQGSGYAADLKSTQNAIDEITNKVNSVIEK

MNTQFTAVGKEFNHLEKRIENLNKKVDDGFLDIWTYNAELLVLLENERTLDYHDSNVKNLYEKVRSQLKNNAKEIGN

GCFEFYHKCDNTCMESVKNGTYDYPKYSEEAKLNREEIDggsggRSCRNSMRQQIQMEVGASLQYLAMGAHFSKDVV

NRPGFAQLFFDAASEEREHAMKLIEYLLMRGELTNDVSSLLQVRPPTRSSWKGGVEALEHALSMESDVTKSIRNVIK

ACEDDSEFNDYHLVDYLTGDFLEEQYKGQRDLAGKASTLKKLMDRHEALGEFIFDKKLLGIDV

A/Switzerland/9715293/2013(H3N2)_5ln_iFerr(H)

(SEQ ID NO: 132)

ATLCLGHHAVPNGTIVKTITNDRIEVTNATELVQNSSIGEICDSPHQILDGENCTLIDALLGDPQCDGFQNKKWDLF

VERSKAYSNCYPYDVPDYASLRSLVASSGTLEFNNESFNWAGVTQNGTSSSCIRGSNSSFFSRLNWLTHLNSKYPAL

NVTMPNNEQFDKLYIWGVHHPGTDKDQIFLYAQSSGRITVSTKRSQQAVIPNIGSRPRIRDIPSRISIYWTIVKPGD

ILLINSTGNLIAPRGYFKIRSGKSSIMRSDAPIGKCKSECITPNGSIPNDKPFQNVNRITYGACPRYVKQSTLKLAT

GMRNVPERQTRGIFGAIAGFIENGWEGMVDGWYGFRHQNSEGRGQAADLKSTQAAIDQINGKLNRLIGKTNEKFHQI

EKEFSEVEGRIQDLEKYVEDTKIDLWSYNAELLVALENQHTIDLTDSEMNKLFEKTKKQLRENAEDMGNGCFKIYHK

CDNACIGSIRNGTYDHDVYRDEALNNRFQIKggsggRSCRNSMRQQIQMEVGASLQYLAMGAHFSKDVVNRPGFAQL

FFDAASEEREHAMKLIEYLLMRGELTNDVSSLLQVRPPTRSSWKGGVEALEHALSMESDVTKSIRNVIKACEDDSEF

NDYHLVDYLTGDFLEEQYKGQRDLAGKASTLKKLMDRHEALGEFIFDKKLLGIDV

B/Phuket/3073/2013_5ln_iFerr(H)

(SEQ ID NO: 133)

DRICTGITSSNSPHVVKTATQGEVNVTGVIPLTTTPTKSYFANLKGTRTRGKLCPDCLNCTDLDVALGRPMCVGTTP

SAKASILHEVRPVTSGCFPIMHDRTKIRQLPNLLRGYEKIRLSTQNVIDAEKAPGGPYRLGTSGSCPNATSKIGFFA

TMAWAVPKDNYKNATNPLTVEVPYICTEGEDQITVWGFHSDNKTQMKSLYGDSNPQKFTSSANGVTTHYVSQIGDFP

DQTEDGGLPQSGRIVVDYMMQKPGKTGTIVYQRGVLLPQKVWCASGRSKVIKGSLPLIGEADCLHEKYGGLNKSKPY

YTGEHAKAIGNCPIWVKTPLKLANGTKYRPPAKLLKERGFFGAIAGFLEGGWEGMIAGWHGYTSHGAHGVAVAADLK

STQEAINKITKNLNSLSELEVKNLQRLSGAMDELHNEILELDEKVDDLRADTISSQIELAVLLSNEGIINSEDEHLL

ALERKLKKMLGPSAVDIGNGCFETKHKCNQTCLDRIAAGTFDAGEFSLPTFDSLNITAggsggRSCRNSMRQQIQME

VGASLQYLAMGAHFSKDVVNRPGFAQLFFDAASEEREHAMKLIEYLLMRGELTNDVSSLLQVRPPTRSSWKGGVEAL

-continued

EHALSMESDVTKSIRNVIKACEDDSEFNDYHLVDYLTGDFLEEQYKGQRDLAGKASTLKKLMDRHEALGEFIFDKKL
LGIDV

B/Brisbane/60/2008_5ln_iFerr(H)

(SEQ ID NO: 134)
DRICTGITSSNSPHVVKTATQGEVNVTGVIPLTTTPTKSHFANLKGTETRGKLCPKCLNCTDLDVALGRPKCTGKIP
SARVSILHEVRPVTSGCFPIMHDRTKIRQLPNLLRGYEHIRLSTHNVINAENAPGGPYKIGTSGSCPNITNGNGFFA
TMAWAVPKNDKNKTATNPLTIEVPYICTEGEDQITVWGFHSDNETQMAKLYGDSKPQKFTSSANGVTTHYVSQIGGF
PNQTEDGGLPQSGRIVVDYMVQKSGKTGTITYQRGILLPQKVWCASGRSKVIKGSLPLIGEADCLHEKYGGLNKSKP
YYTGEHAKAIGNCPIWVKTPLKLANGTKYRPPAKLLKERGFFGAIAGFLEGGWEGMIAGWHGYTSHGAHGVAVAADL
KSTQEAINKITKNLNSLSELEVKNLQRLSGAMDELHNEILELDEKVDDLRADTISSQIELAVLLSNEGIINSEDEHL
LALERKLKKMLGPSAVEIGNGCFETKHKCNQTCLDRIAAGTFDAGEFSLPTFDSLNITAggsgggRSCRNSMRQQIQM
EVGASLQYLAMGAHFSKDVVNRPGFAQLFFDAASEEREHAMKLIEYLLMRGELTNDVSSLLQVRPPTRSSWKGGVEA
LEHALSMESDVTKSIRNVIKACEDDSEFNDYHLVDYLTGDFLEEQYKGQRDLAGKASTLKKLMDRHEALGEFIFDKK
LLGIDV H1CA HA(518)_5ln_iFerr(L)

(SEQ ID NO: 135)
DTLCIGYHANNSTDTVDTVLEKNVTVTHSVNLLEDKHNGKLCKLRGVAPLHLGKCNIAGWILGNPECESLSTASSWS
YIVETPSSDNGTCYPGDFIDYEELREQLSSVSSFERFEIFPKTSSWPNHDSNKGVTAACPHAGAKSFYKNLIWLVKK
GNSYPKLSKSYINDKGKEVLVLWGIHHPSTSADQQSLYQNADTYVFVGSSRYSKKFKPEIAIRPKVRDQEGRMNYYW
TLVEPGDKITFEATGNLVVPRYAFAMERNAGSGIIISDTPVHDCNTTCQTPKGAINTSLPFQNIHPITIGKCPKYVK
STKLRLATGLRNIPSIQSRGLFGAIAGFIEGGWTGMVDGWYGYHHQNEQGSGYAADLKSTQNAIDEITNKVNSVIEK
MNTQFTAVGKEFNHLEKRIENLNKKVDDGFLDIWTYNAELLVLLENERTLDYHDSNVKNLYEKVRSQLKNNAKEIGN
GCFEFYHKCDNTCMESVKNGTYDYPKYSEEAKLNREEIDggsgggEYGSHGNVATELQAYAKLHLERSYDYLLSAAYF
NNYQTNRAGFSKLFKKLSDEAWSKTIDIIKHVTKRGDKMNFDQHSTMKTERKNYTAENHELEALAKALDTQKELAER
AFYIHREATRNSQHLHDPEIAQYLEEEFIEDHAEKIRTLAGHTSDLKKFITANNGHDLSLALYVFDEYLQKTV H7AnhuiHA_5ln_iFerr(L)

(SEQ ID NO: 136)
DKICLGHHAVSNGTKVNTLTERGVEVVNATETVERTNIPRICSKGKRTVDLGQCGLLGTITGPPQCDQFLEFSADLI

IERREGSDVCYPGKFVNEEALRQILRESGGIDKEAMGFTYSGIRTNGATSACRRSGSSFYAEMKWLLSNTDNAAFPQ

MTKSYKNTRKSPALIVWGIHHSVSTAEQTKLYGSGNKLVTVGSSNYQQSFVPSPGARPQVNGLSGRIDFHWLMLNPN

DTVTFSFNGAFIAPDRASFLRGKSMGIQSGVQVDANCEGDCYHSGGTIISNLPFQNIDSRAVGKCPRYVKQRSLLLA

TGMKNVPEIPKGRGLFGAIAGFIENGWEGLIDGWYGFRHQNAQGEGTAADYKSTQSAIDQITGKLNRLIEKTNQQFE

LIDNEFNEVEKQIGNVINWTRDSITEVWSYNAELLVAMENQHTIDLADSEMDKLYERVKRQLRENAEEDGTGCFEIF

HKCDDDCMASIRNNTYDHSKYREEAMQNRIQIDggsggEYGSHGNVATELQAYAKLHLERSYDYLLSAAYFNNYQTN

RAGFSKLFKKLSDEAWSKTIDIIKHVTKRGDKMNFDQHSTMKTERKNYTAENHELEALAKALDTQKELAERAFYIHR

EATRNSQHLHDPEIAQYLEEEFIEDHAEKIRTLAGHTSDLKKFITANNGHDLSLALYVFDEYLQKTV

A/California/07/2009(H1N1)_5ln_iFerr(L)

(SEQ ID NO: 137)

DTLCIGYHANNSTDTVDTVLEKNVTVTHSVNLLEDKHNGKLCKLRGVAPLHLGKCNIAGWILGNPECESLSTASSWS

YIVETPSSDNGTCYPGDFIDYEELREQLSSVSSFERFEIFPKTSSWPNHDSNKGVTAACPHAGAKSFYKNLIWLVKK

GNSYPKLSKSYINDKGKEVLVLWGIHHPSTSADQQSLYQNADAYVFVGSSRYSKKFKPEIAIRPKVRDREGRMNYYW

TLVEPGDKITFEATGNLVVPRYAFAMERNAGSGIIISDTPVHDCNTTCQTPKGAINTSLPFQNIHPITIGKCPKYVK

STKLRLATGLRNIPSIQSRGLFGAIAGFIEGGWTGMVDGWYGYHHQNEQGSGYAADLKSTQNAIDEITNKVNSVIEK

MNTQFTAVGKEFNHLEKRIENLNKKVDDGFLDIWTYNAELLVLLENERTLDYHDSNVKNLYEKVRSQLKNNAKEIGN

-continued

GCFEFYHKCDNTCMESVKNGTYDYPKYSEEAKLNREEIDggsggEYGSHGNVATELQAYAKLHLERSYDYLLSAAYF

NNYQTNRAGFSKLFKKLSDEAWSKTIDIIKHVTKRGDKMNFDQHSTMKTERKNYTAENHELEALAKALDTQKELAER

AFYIHREATRNSQHLHDPEIAQYLEEEFIEDHAEKIRTLAGHTSDLKKFITANNGHDLSLALYVFDEYLQKTV

A/Switzerland/9715293/2013(H3N2)_5ln_iFerr(L)

(SEQ ID NO: 138)

ATLCLGHHAVPNGTIVKTITNDRIEVTNATELVQNSSIGEICDSPHQILDGENCTLIDALLGDPQCDGFQNKKWDLF

VERSKAYSNCYPYDVPDYASLRSLVASSGTLEFNNESFNWAGVTQNGTSSSCIRGSNSSFFSRLNWLTHLNSKYPAL

NVTMPNNEQFDKLYIWGVHHPGTDKDQIFLYAQSSGRITVSTKRSQQAVIPNIGSRPRIRDIPSRISIYWTIVKPGD

ILLINSTGNLIAPRGYFKIRSGKSSIMRSDAPIGKCKSECITPNGSIPNDKPFQNVNRITYGACPRYVKQSTLKLAT

GMRNVPERQTRGIFGAIAGFIENGWEGMVDGWYGFRHQNSEGRGQAADLKSTQAAIDQINGKLNRLIGKTNEKFHQI

EKEFSEVEGRIQDLEKYVEDTKIDLWSYNAELLVALENQHTIDLTDSEMNKLFEKTKKQLRENAEDMGNGCFKIYHK

CDNACIGSIRNGTYDHDVYRDEALNNRFQIKggsggEYGSHGNVATELQAYAKLHLERSYDYLLSAAYFNNYQTNRA

GFSKLFKKLSDEAWSKTIDIIKHVTKRGDKMNFDQHSTMKTERKNYTAENHELEALAKALDTQKELAERAFYIHREA

TRNSQHLHDPEIAQYLEEEFIEDHAEKIRTLAGHTSDLKKFITANNGHDLSLALYVFDEYLQKTV

B/Phuket/3073/2013_5ln_iFerr(L)

(SEQ ID NO: 139)

DRICTGITSSNSPHVVKTATQGEVNVTGVIPLTTTPTKSYFANLKGTRTRGKLCPDCLNCTDLDVALGRPMCVGTTP

SAKASILHEVRPVTSGCFPIMHDRTKIRQLPNLLRGYEKIRLSTQNVIDAEKAPGGPYRLGTSGSCPNATSKIGFFA

TMAWAVPKDNYKNATNPLTVEVPYICTEGEDQITVWGFHSDNKTQMKSLYGDSNPQKFTSSANGVTTHYVSQIGDFP

DQTEDGGLPQSGRIVVDYMMQKPGKTGTIVYQRGVLLPQKVWCASGRSKVIKGSLPLIGEADCLHEKYGGLNKSKPY

YTGEHAKAIGNCPIWVKTPLKLANGTKYRPPAKLLKERGFFGAIAGFLEGGWEGMIAGWHGYTSHGAHGVAVAADLK

STQEAINKITKNLNSLSELEVKNLQRLSGAMDELHNEILELDEKVDDLRADTISSQIELAVLLSNEGIINSEDEHLL

ALERKLKKMLGPSAVDIGNGCFETKHKCNQTCLDRIAAGTFDAGEFSLPTFDSLNITAggsggEYGSHGNVATELQA

YAKLHLERSYDYLLSAAYFNNYQTNRAGFSKLFKKLSDEAWSKTIDIIKHVTKRGDKMNFDQHSTMKTERKNYTAEN

HELEALAKALDTQKELAERAFYIHREATRNSQHLHDPEIAQYLEEEFIEDHAEKIRTLAGHTSDLKKFITANNGHDL

SLALYVFDEYLQKTV

B/Brisbane/60/2008_5ln_iFerr(L)

(SEQ ID NO: 140)

DRICTGITSSNSPHVVKTATQGEVNVTGVIPLTTTPTKSHFANLKGTETRGKLCPKCLNCTDLDVALGRPKCTGKIP

SARVSILHEVRPVTSGCFPIMHDRTKIRQLPNLLRGYEHIRLSTHNVINAENAPGGPYKIGTSGSCPNITNGNGFFA

TMAWAVPKNDKNKTATNPLTIEVPYICTEGEDQITVWGFHSDNETQMAKLYGDSKPQKFTSSANGVTTHYVSQIGGF

PNQTEDGGLPQSGRIVVDYMVQKSGKTGTITYQRGILLPQKVWCASGRSKVIKGSLPLIGEADCLHEKYGGLNKSKP

YYTGEHAKAIGNCPIWVKTPLKLANGTKYRPPAKLLKERGFFGAIAGFLEGGWEGMIAGWHGYTSHGAHGVAVAADL

KSTQEAINKITKNLNSLSELEVKNLQRLSGAMDELHNEILELDEKVDDLRADTISSQIELAVLLSNEGIINSEDEHL

LALERKLKKMLGPSAVEIGNGCFETKHKCNQTCLDRIAAGTFDAGEFSLPTFDSLNITAggsggEYGSHGNVATELQ

AYAKLHLERSYDYLLSAAYFNNYQTNRAGFSKLFKKLSDEAWSKTIDIIKHVTKRGDKMNFDQHSTMKTERKNYTAE

NHELEALAKALDTQKELAERAFYIHREATRNSQHLHDPEIAQYLEEEFIEDHAEKIRTLAGHTSDLKKFITANNGHD

LSLALYVFDEYLQKTV

Any of the above recombinant insect ferritin light chain fusion proteins can be paired with any of the above recombinant insect ferritin heavy chain fusion proteins to generate a recombinant insect ferritin nanoparticle that displays influenza HA ectodomains on its surface. In some embodiments, the recombinant insect ferritin nanoparticle can comprise a recombinant insect ferritin light chain fusion protein and a recombinant insect ferritin heavy chain fusion protein respectively comprising one of the following pairs of SEQ ID NOs: 135 and 129, 135 and 130, 135 and 131, 135 and 132, 135 and 133, 135 and 134, 136 and 129, 136 and 130, 136 and 131, 136 and 132, 136 and 133, 136 and 134, 137 and 129, 137 and 130, 137 and 131, 137 and 132, 137 and 133, 137 and 134, 138 and 129, 138 and 130, 138 and 131, 138 and 132, 138 and 133, 138 and 134, 139 and 129, 139 and 130, 139 and 131, 139 and 132, 139 and 133, 139 and 134, 140 and 129, 140 and 130, 140 and 131, 140 and 132, 140 and 133, or 140 and 134.

In additional embodiments, a recombinant form of the stem of an influenza HA protein can be included on a recombinant insect ferritin heavy or light chain fusion protein as described herein to generate a recombinant insect ferritin nanoparticle including the recombinant influenza HA stem in trimeric form. In the purified recombinant insect ferritin nanoparticle, a signal peptide is typically not included as this sequence is removed by proteolytic processing when the recombinant fusion protein is expressed in a cell. The recombinant influenza HA stem included on the recombinant insect ferritin nanoparticle can include one or more modifications from a native influenza HA protein sequence that has been determined to stabilize the HA protein in a conformation that induces production of neutralizing antibodies when administered to a subject, for example neutralizing antibodies that specifically bind the HA stem region.

Sequences of exemplary insect ferritin heavy and light chain fusion proteins including heavy or light chain ferritin subunits fused to recombinant influenza HA stem proteins are provided below:

```
>H1_iferr(H)_01
                                                          (SEQ ID NO: 166)
DTICIGYHANNSTDTVDTVLEKNVTVTHSVNLGSGLRMVTGLRNIPQRETRGLFGAIAGFIEGGWTGMVDGWYGYHH

QNEQGSGYAADQKSTQNAINGITNMVNSVIEKMGSGGSGTDLAELLVLLLNERTLDFHDSNVKNLYEKVKSQLKNNA

KEIGNGCFEFYHKCNNECMESVKNGTYDYPKYSEESKLNREKIDGGSGGRSCRNSMRQQIQMEVGASLQYLAMGAHF

SKDVVNRPGFAQLFFDAASEEREHAMKLIEYLLMRGELTNDVSSLLQVRPPTRSSWKGGVEALEHALSMESDVTKSI

RNVIKACEDDSEFNDYHLVDYLTGDFLEEQYKGQRDLAGKASTLKKLMDRHEALGEFIFDKKLLGIDV

>H1_iferr(L)_01
                                                          (SEQ ID NO: 167)
DTICIGYHANNSTDTVDTVLEKNVTVTHSVNLGSGLRMVTGLRNIPQRETRGLFGAIAGFIEGGWTGMVDGWYGYHH

QNEQGSGYAADQKSTQNAINGITNMVNSVIEKMGSGGSGTDLAELLVLLLNERTLDFHDSNVKNLYEKVKSQLKNNA

KEIGNGCFEFYHKCNNECMESVKNGTYDYPKYSEESKLNREKIDGGSGGEYGSHGNVATELQAYAKLHLERSYDYLL

SAAYFNNYQTNRAGFSKLFKKLSDEAWSKTIDIIKHVTKRGDKMNFDQHSTMKTERKNYTAENHELEALAKALDTQK

ELAERAFYIHREATRNSQHLHDPEIAQYLEEEFIEDHAEKIRTLAGHTSDLKKFITANNGHDLSLALYVFDEYLQKT

V

>H1_iferr(L)_02
                                                          (SEQ ID NO: 168)
DTICIGYHANNSTDTVDTVLEKNVTVTHSVNLGSGLRMVTGLRNIPQRETRGLFGAIAGFIEGGWTGMVDGWYGYHH

QNEQGSGYAADQKSTQNAINGITNMVNSVIEKMGSGGSGTDLAELLVLLLNERTLDFHDSNVKNLYEKVKSQLKNNA

KEIGNGCFEFYHKCNNECMESVKNGTYDYPKYSEESKLNREKIDGGSGGNVATELQAYAKLHLERSYDYLLSAAYFN

NYQTNRAGFSKLFKKLSDEAWSKTIDIIKHVTKRGDKMNFDQHSTMKTERKNYTAENHELEALAKALDTQKELAERA

FYIHREATRNSQHLHDPEIAQYLEEEFIEDHAEKIRTLAGHTSDLKKFITANNGHDLSLALYVFDEYLQKTV

>H3-231_iferr(H)_01
                                                          (SEQ ID NO: 169)
QKLPGNDNSTATLCLGHHAVPNGTIVKTITNDQIEVTNATELVFPGCGVLKLATGMRNVPEKQTRGIFGAIAGFIEN

GWEGMVDGWYGFRHQNSEGIGQAADLKSTQAAINQINGMVNRVIALMAQGGPDCYLAELLVALLNQHVIDLTDSEMR

KLFERTKKQLRENAEDMGNGCFKIYHKCDNACIGSIRNGTYDHDVYRDEALNNRFQIKGGSGGRSCRNSMRQQIQME

VGASLQYLAMGAHFSKDVVNRPGFAQLFFDAASEEREHAMKLIEYLLMRGELTNDVSSLLQVRPPTRSSWKGGVEAL

EHALSMESDVTKSIRNVIKACEDDSEFNDYHLVDYLTGDFLEEQYKGQRDLAGKASTLKKLMDRHEALGEFIFDKKL

LGIDV

>H3-231_iferr(L)_01
                                                          (SEQ ID NO: 170)
QKLPGNDNSTATLCLGHHAVPNGTIVKTITNDQIEVTNATELVFPGCGVLKLATGMRNVPEKQTRGIFGAIAGFIEN

GWEGMVDGWYGFRHQNSEGIGQAADLKSTQAAINQINGMVNRVIALMAQGGPDCYLAELLVALLNQHVIDLTDSEMR

KLFERTKKQLRENAEDMGNGCFKIYHKCDNACIGSIRNGTYDHDVYRDEALNNRFQIKGGSGGEYGSHGNVATELQA

YAKLHLERSYDYLLSAAYFNNYQTNRAGFSKLFKKLSDEAWSKTIDIIKHVTKRGDKMNFDQHSTMKTERKNYTAEN

HELEALAKALDTQKELAERAFYIHREATRNSQHLHDPEIAQYLEEEFIEDHAEKIRTLAGHTSDLKKFITANNGHDL

SLALYVFDEYLQKTV
```

-continued

>H3-231_iferr(L)_02

(SEQ ID NO: 171)

QKLPGNDNSTATLCLGHHAVPNGTIVKTITNDQIEVTNATELVFPGCGVLKLATGMRNVPEKQTRGIFGAIAGFIEN

GWEGMVDGWYGFRHQNSEGIGQAADLKSTQAAINQINGMVNRVIALMAQGGPDCYLAELLVALLNQHVIDLTDSEMR

KLFERTKKQLRENAEDMGNGCFKIYHKCDNACIGSIRNGTYDHDVYRDEALNNRFQIKAGGSGGNVATELQAYAKLH

LERSYDYLLSAAYFNNYQTNRAGFSKLFKKLSDEAWSKTIDIIKHVTKRGDKMNFDQHSTMKTERKNYTAENHELEA

LAKALDTQKELAERAFYIHREATRNSQHLHDPEIAQYLEEEFIEDHAEKIRTLAGHTSDLKKFITANNGHDLSLALY

VFDEYLQKTV

>H3-249_iferr(H)_01

(SEQ ID NO: 172)

QKLPGNDNSTATLCLGHHAVPNGTIVKTITNDQIEVTNATELCFNGICLKLATGMRNVPEKQTRGIFGAIAGFIENG

WEGMVDGWYGFRHQNSEGIGQAADLKSTQAAINQINGMVNRVIALMAQGGPDCYLAELLVALLNQHVIDLTDSEMRK

LFERTKKQLRENAEDMGNGCFKIYHKCDNACIGSIRNGTYDHDVYRDEALNNRFQIKGGSGGRSCRNSMRQQIQMEV

GASLQYLAMGAHFSKDVVNRPGFAQLFFDAASEEREHAMKLIEYLLMRGELTNDVSSLLQVRPPTRSSWKGGVEALE

HALSMESDVTKSIRNVIKACEDDSEFNDYHLVDYLTGDFLEEQYKGQRDLAGKASTLKKLMDRHEALGEFIFDKKLL

GIDV

>H3-249_iferr(L)_01

(SEQ ID NO: 173)

QKLPGNDNSTATLCLGHHAVPNGTIVKTITNDQIEVTNATELCFNGICLKLATGMRNVPEKQTRGIFGAIAGFIENG

WEGMVDGWYGFRHQNSEGIGQAADLKSTQAAINQINGMVNRVIALMAQGGPDCYLAELLVALLNQHVIDLTDSEMRK

LFERTKKQLRENAEDMGNGCFKIYHKCDNACIGSIRNGTYDHDVYRDEALNNRFQIKGGSGGEYGSHGNVATELQAY

AKLHLERSYDYLLSAAYFNNYQTNRAGFSKLFKKLSDEAWSKTIDIIKHVTKRGDKMNFDQHSTMKTERKNYTAENH

ELEALAKALDTQKELAERAFYIHREATRNSQHLHDPEIAQYLEEEFIEDHAEKIRTLAGHTSDLKKFITANNGHDLS

LALYVFDEYLQKTV

>H3-249_iferr(L)_02

(SEQ ID NO: 174)

QKLPGNDNSTATLCLGHHAVPNGTIVKTITNDQIEVTNATELCFNGICLKLATGMRNVPEKQTRGIFGAIAGFIENG

WEGMVDGWYGFRHQNSEGIGQAADLKSTQAAINQINGMVNRVIALMAQGGPDCYLAELLVALLNQHVIDLTDSEMRK

LFERTKKQLRENAEDMGNGCFKIYHKCDNACIGSIRNGTYDHDVYRDEALNNRFQIKAGGSGGNVATELQAYAKLHL

ERSYDYLLSAAYFNNYQTNRAGFSKLFKKLSDEAWSKTIDIIKHVTKRGDKMNFDQHSTMKTERKNYTAENHELEAL

AKALDTQKELAERAFYIHREATRNSQHLHDPEIAQYLEEEFIEDHAEKIRTLAGHTSDLKKFITANNGHDLSLALYV

FDEYLQKTV

H3-256_iferr(H)_01

(SEQ ID NO: 175)

QKLPGNDNSTATLCLGHHAVPNGTIVKTITNDQIEVTNATELVFPGCGVLKLATGMRNVPEKQTRGIFGAIAGFIEN

GWEGMVDGWYGFRHQNSEGIGQAADLKSTQAAINQINGMVNRVIELMEQGGPDCYLAELLVALLNQHVIDLTDSEMR

KLFERTKKQLRENAEDMGNGCFKIYHKCDNACIGSIRNGTYDHDVYRDEALNNRFQIKGGSGGRSCRNSMRQQIQME

VGASLQYLAMGAHFSKDVVNRPGFAQLFFDAASEEREHAMKLIEYLLMRGELTNDVSSLLQVRPPTRSSWKGGVEAL

EHALSMESDVTKSIRNVIKACEDDSEFNDYHLVDYLTGDFLEEQYKGQRDLAGKASTLKKLMDRHEALGEFIFDKKL

LGIDV

H3-256_iferr(L)_01

(SEQ ID NO: 176)

QKLPGNDNSTATLCLGHHAVPNGTIVKTITNDQIEVTNATELVFPGCGVLKLATGMRNVPEKQTRGIFGAIAGFIEN

GWEGMVDGWYGFRHQNSEGIGQAADLKSTQAAINQINGMVNRVIELMEQGGPDCYLAELLVALLNQHVIDLTDSEMR

KLFERTKKQLRENAEDMGNGCFKIYHKCDNACIGSIRNGTYDHDVYRDEALNNRFQIKGGSGGEYGSHGNVATELQA

YAKLHLERSYDYLLSAAYFNNYQTNRAGFSKLFKKLSDEAWSKTIDIIKHVTKRGDKMNFDQHSTMKTERKNYTAEN

-continued

HELEALAKALDTQKELAERAFYIHREATRNSQHLHDPEIAQYLEEEFIEDHAEKIRTLAGHTSDLKKFITANNGHDL
SLALYVFDEYLQKTV

>H7-20_iferr(H)_01 (SEQ ID NO: 177)
DKICLGHHAVSNGTKVNTLTERGVEVVNATELVFPCGVLKLATGMKNVPEIPKGRGLFGAIAGFIENGWEGLIDGWY
GFRHQNAQGEGTAADYKSTQSAIDQITGMVNRVIALMAQGGPDCYLAELLVAMLNQHVIDLADSEMDKLYERVKRQL
RENAEEDGTGCFEIFHKCDDDCMASIRNNTYDHSKYREEAMQNRIQIDGGSGGRSCRNSMRQQIQMEVGASLQYLAM
GAHFSKDVVNRPGFAQLFFDAASEEREHAMKLIEYLLMRGELTNDVSSLLQVRPPTRSSWKGGVEALEHALSMESDV
TKSIRNVIKACEDDSEFNDYHLVDYLTGDFLEEQYKGQRDLAGKASTLKKLMDRHEALGEFIFDKKLLGIDV >H7-20_iferr(L)_01 (SEQ ID NO: 178)
DKICLGHHAVSNGTKVNTLTERGVEVVNATELVFPCGVLKLATGMKNVPEIPKGRGLFGAIAGFIENGWEGLIDGWY
GFRHQNAQGEGTAADYKSTQSAIDQITGMVNRVIALMAQGGPDCYLAELLVAMLNQHVIDLADSEMDKLYERVKRQL
RENAEEDGTGCFEIFHKCDDDCMASIRNNTYDHSKYREEAMQNRIQIDGGSGGEYGSHGNVATELQAYAKLHLERSY
DYLLSAAYFNNYQTNRAGFSKLFKKLSDEAWSKTIDIIKHVTKRGDKMNFDQHSTMKTERKNYTAENHELEALAKAL
DTQKELAERAFYIHREATRNSQHLHDPEIAQYLEEEFIEDHAEKIRTLAGHTSDLKKFITANNGHDLSLALYVFDEY
LQKTV >H7-20_iferr(L)_02 (SEQ ID NO: 179)
DKICLGHHAVSNGTKVNTLTERGVEVVNATELVFPCGVLKLATGMKNVPEIPKGRGLFGAIAGFIENGWEGLIDGWY
GFRHQNAQGEGTAADYKSTQSAIDQITGMVNRVIALMAQGGPDCYLAELLVAMLNQHVIDLADSEMDKLYERVKRQL
RENAEEDGTGCFEIFHKCDDDCMASIRNNTYDHSKYREEAMQNRIQIDAGGSGGNVATELQAYAKLHLERSYDYLLS
AAYFNNYQTNRAGFSKLFKKLSDEAWSKTIDIIKHVTKRGDKMNFDQHSTMKTERKNYTAENHELEALAKALDTQKE
LAERAFYIHREATRNSQHLHDPEIAQYLEEEFIEDHAEKIRTLAGHTSDLKKFITANNGHDLSLALYVFDEYLQKTV H7-23_iferr(H)_01 (SEQ ID NO: 180)
DKICLGHHAVSNGTKVNTLTERGVEVVNATELVFPCGVLKLATGMKNVPEIPKGRGLFGAIAGFIENGWEGLIDGW
YGFRHQNAQGEGTAADYKSTQSAIDQITGMVNRVIALMAQGPPDCYLAELLVAMLNQHVIDLADSEMDKLYERVKRQ
LRENAEEDGTGCFEIFHKCDDDCMASIRNNTYDHSKYREEAMQNRIQIDGGSGGRSCRNSMRQQIQMEVGASLQYLA
MGAHFSKDVVNRPGFAQLFFDAASEEREHAMKLIEYLLMRGELTNDVSSLLQVRPPTRSSWKGGVEALEHALSMESD
VTKSIRNVIKACEDDSEFNDYHLVDYLTGDFLEEQYKGQRDLAGKASTLKKLMDRHEALGEFIFDKKLLGIDV H7-23_iferr(L)_01 (SEQ ID NO: 181)
DKICLGHHAVSNGTKVNTLTERGVEVVNATELVFPCGVLKLATGMKNVPEIPKGRGLFGAIAGFIENGWEGLIDGW
YGFRHQNAQGEGTAADYKSTQSAIDQITGMVNRVIALMAQGPPDCYLAELLVAMLNQHVIDLADSEMDKLYERVKRQ
LRENAEEDGTGCFEIFHKCDDDCMASIRNNTYDHSKYREEAMQNRIQIDGGSGGEYGSHGNVATELQAYAKLHLERS
YDYLLSAAYFNNYQTNRAGFSKLFKKLSDEAWSKTIDIIKHVTKRGDKMNFDQHSTMKTERKNYTAENHELEALAKA
LDTQKELAERAFYIHREATRNSQHLHDPEIAQYLEEEFIEDHAEKIRTLAGHTSDLKKFITANNGHDLSLALYVFDE
YLQKTV H7-26_iferr(H)_01 (SEQ ID NO: 182)
DKICLGHHAVSNGTKVNTLTERGVEVVNATELVFPCGVLKLATGMKNVPEIPKGRGLFGAIAGFIENGWEGLIDGW
YGFRHQNAQGEGTAADYKSTQSAIDQITGMVNRVIELMEQGGPDCYLAELLVAMLNQHVIDLADSEMDKLYERVKRQ
LRENAEEDGTGCFEIFHKCDDDCMASIRNNTYDHSKYREEAMQNRIQIDGGSGGRSCRNSMRQQIQMEVGASLQYLA
MGAHFSKDVVNRPGFAQLFFDAASEEREHAMKLIEYLLMRGELTNDVSSLLQVRPPTRSSWKGGVEALEHALSMESD
VTKSIRNVIKACEDDSEFNDYHLVDYLTGDFLEEQYKGQRDLAGKASTLKKLMDRHEALGEFIFDKKLLGIDV

```
H7-26_iferr(L)_01
                                                            (SEQ ID NO: 183)
DKICLGHHAVSNGTKVNTLTERGVEVVNATELVFPGCGVLKLATGMKNVPEIPKGRGLFGAIAGFIENGWEGLIDGW

YGFRHQNAQGEGTAADYKSTQSAIDQITGMVNRVIELMEQGGPDCYLAELLVAMLNQHVIDLADSEMDKLYERVKRQ

LRENAEEDGTGCFEIFHKCDDDCMASIRNNTYDHSKYREEAMQNRIQIDGGSGGEYGSHGNVATELQAYAKLHLERS

YDYLLSAAYFNNYQTNRAGFSKLFKKLSDEAWSKTIDIIKHVTKRGDKMNFDQHSTMKTERKNYTAENHELEALAKA

LDTQKELAERAFYIHREATRNSQHLHDPEIAQYLEEEFIEDHAEKIRTLAGHTSDLKKFITANNGHDLSLALYVFDE

YLQKTV
```

In some embodiments, any of SEQ ID NOs: 166-168 can include an N-terminal signal peptide (such as an H1 HA signal peptide, such as MKAKLLVLLCTFTATYA, SEQ ID NO: 184) for expression purposes, which typically is removed by proteolytic processing in the cell. In some embodiments, any of SEQ ID NOs: 169-176 can include an N-terminal signal peptide (such as an H3 HA signal peptide, such as MKTIIALSYILCLVFA, SEQ ID NO: 185) for expression purposes, which typically is removed by proteolytic processing in the cell. In some embodiments, any of SEQ ID NOs: 177-183 can include an N-terminal signal peptide (such as an H7 HA signal peptide, such as MNTQIL-VFALIAIIPTNA. SEQ ID NO: 186) for expression purposes, which typically is removed by proteolytic processing in the cell.

Additional information concerning recombinant influenza HA stem proteins (such as stabilized HA stem proteins) displayed on the surface of ferritin nanoparticles (in the one-component nanoparticle context), including discussion of relevant sequence, production, and use, can be found in WO2015183969, which is incorporated by reference herein in its entirety.

Any of the above recombinant insect ferritin light chain fusion proteins can be paired with any of the above recombinant insect ferritin heavy chain fusion proteins to generate a recombinant insect ferritin nanoparticle that displays influenza HA stem proteins on its surface. In some embodiments, the recombinant insect ferritin nanoparticle can comprise a recombinant insect ferritin light chain fusion protein and a recombinant insect ferritin heavy chain fusion protein respectively comprising one of the following pairs of SEQ ID NOs: 166 and 167, 166 and 168, 166 and 170, 166 and 171, 166 and 173, 166 and 174, 166 and 176, 166 and 178, 166 and 179, 166 and 181, 166 and 183, 169 and 167, 169 and 168, 169 and 170, 169 and 171, 169 and 173, 169 and 174, 169 and 176, 169 and 178, 169 and 179, 169 and 181, 169 and 183, 172 and 167, 172 and 168, 172 and 170, 172 and 171, 172 and 173, 172 and 174, 172 and 176, 172 and 178, 172 and 179, 172 and 181, 172 and 183, 175 and 167, 175 and 168, 175 and 170, 175 and 171, 175 and 173, 175 and 174, 175 and 176, 175 and 178, 175 and 179, 175 and 181, 175 and 183, 177 and 167, 177 and 168, 177 and 170, 177 and 171, 177 and 173, 177 and 174, 177 and 176, 177 and 178, 177 and 179, 177 and 181, 177 and 183, 180 and 167, 180 and 168, 180 and 170, 180 and 171, 180 and 173, 180 and 174, 180 and 176, 180 and 178, 180 and 179, 180 and 181, 180 and 183, 182 and 167, 182 and 168, 182 and 170, 182 and 171, 182 and 173, 182 and 174, 182 and 176, 182 and 178, 182 and 179, 182 and 181, or 182 and 183.

3. RSV F Ectodomains

In some embodiments, the insect ferritin heavy chain fusion proteins and/or insect ferritin light chain fusion proteins of the recombinant insect ferritin nanoparticle can comprise first or second proteins that are RSV F ectodomains, to produce a recombinant insect ferritin nanoparticle with trimeric RSV F ectodomains on its surface.

Respiratory Syncytial Virus (RSV) is an enveloped non-segmented negative-sense single-stranded RNA virus of the family Paramyxoviridae. The RSV genome is ~15,000 nucleotides in length and includes 10 genes encoding 11 proteins, including the F glycoprotein, which mediates fusion, allowing entry of the virus into the cell cytoplasm and also promoting the formation of syncytia. Two subtypes of human RSV strains have been described, the A and B subtypes. RSV strains from other species are also known, including bovine RSV. Exemplary RSV strain sequences are known. Further, several models of human RSV infection are available, including model organisms infected with hRSV, as well as model organisms infected with species specific RSV, such as use of bRSV infection in cattle (see, e.g., Bern et al., *Am J. Physiol. Lung Cell Mol. Physiol.*, 301: L148-L156, 2011).

The RSV Fusion (F) protein is an RSV envelope glycoprotein that facilitates fusion of viral and cellular membranes. In nature, the RSV F protein is initially synthesized as a single polypeptide precursor approximately 574 amino acids in length, designated $F_0$. $F_0$ includes an N-terminal signal peptide that directs localization to the endoplasmic reticulum, where the signal peptide (approximately the first 25 residues of $F_0$) is proteolytically cleaved. The remaining $F_0$ residues oligomerize to form a trimer which is again proteolytically processed by a cellular protease at two conserved consensus furin cleavage sequences (approximately $F_0$ positions 109 and 136; for example, $RARR_{109}$ (positions 106-109) and $RKRR_{136}$ (positions 133-136) to generate two disulfide-linked fragments, $F_1$ and $F_2$. The smaller of these fragments, $F_2$, originates from the N-terminal portion of the $F_0$ precursor and includes approximately residues 26-109 of $F_0$. The larger of these fragments, $F_1$, includes the C-terminal portion of the $F_0$ precursor (approximately residues 137-574) including an extracellular/lumenal region (~residues 137-529), a transmembrane domain (~residues 530-550), and a cytoplasmic tail (~residues 551-574) at the C-terminus.

Three $F_2$-$F_1$ protomers oligomerize in the mature F protein trimer, which adopts a metastable "prefusion" conformation that is triggered to undergo a conformational change to a "postfusion" conformation upon contact with a target cell membrane. This conformational change exposes a hydrophobic sequence, known as the fusion peptide, which is located at the N-terminus of the $F_1$ ectodomain, and which associates with the host cell membrane and promotes fusion of the membrane of the virus, or an infected cell, with the target cell membrane. The extracellular portion of the RSV F protein is the RSV F ectodomain, which includes the $F_2$ protein and the F₁ ectodomain. An RSV F ectodomain trimer includes a protein complex of three RSV F ectodomains.

In the prefusion conformation, the RSV F ectodomain trimer includes an antigenic site at its membrane distal apex termed "antigenic site Ø," that includes RSV F residues 62-69 and 196-209, and also includes the epitopes of the 5C4, D25 and AM22 monoclonal antibodies (see, McLellan et al., *Science*, 340(6136): p. 1113-7, 2013, McLellan et al., *Science*, 342:592-598, 2013, and structural coordinates provided in PDB Accession No. 4JHW, each of which is incorporated by reference herein in its entirety).

Native RSV F proteins from different RSV groups, as well as nucleic acid sequences encoding such proteins and methods, are known. For example, the sequence of several exemplary subtype A, B and bovine precursor RSV F₀ proteins are provided below:

```
(1) RSV F subtype A (Accession No. P03420.1, incorporated by reference
herein in its entirety)
                                                          (SEQ ID NO: 141)
MELLILKANAITTILTAVTFCFASGQNITEEFYQSTCSAVSKGYLSALRTGWYTSVITIELSNIKENKCNGTDAKVK

LIKQELDKYKNAVTELQLLMQSTPPTNNRARRELPRFMNYTLNNAKKTNVTLSKKRKRRFLGFLLGVGSAIASGVAV

SKVLHLEGEVNKIKSALLSTNKAVVSLSNGVSVLTSKVLDLKNYIDKQLLPIVNKQSCSISNIETVIEFQQKNNRLL

EITREFSVNAGVTTPVSTYMLTNSELLSLINDMPITNDQKKLMSNNVQIVRQQSYSIMSIIKEEVLAYVVQLPLYGV

IDTPCWKLHTSPLCTTNTKEGSNICLTRTDRGWYCDNAGSVSFFPQAETCKVQSNRVFCDTMNSLTLPSEINLCNVD

IFNPKYDCKIMTSKTDVSSSVITSLGAIVSCYGKTKCTASNKNRGIIKTFSNGCDYVSNKGMDTVSVGNTLYYVNKQ

EGKSLYVKGEPIINFYDPLVFPSDEFDASISQVNEKINQSLAFIRKSDELLHNVNAGKSTTNIMITTIIIVIIVILL

SLIAVGLLLYCKARSTPVTLSKDQLSGINNIAFSN (2) RSV F subtype A (Accession No. P03420.1 with P102A substitution)
                                                          (SEQ ID NO: 142)
MELLILKANAITTILTAVTFCFASGQNITEEFYQSTCSAVSKGYLSALRTGWYTSVITIELSNIKENKCNGTDAKVK

LIKQELDKYKNAVTELQLLMQSTPATNNRARRELPRFMNYTLNNAKKTNVTLSKKRKRRFLGFLLGVGSAIASGVAV

SKVLHLEGEVNKIKSALLSTNKAVVSLSNGVSVLTSKVLDLKNYIDKQLLPIVNKQSCSISNIETVIEFQQKNNRLL

EITREFSVNAGVTTPVSTYMLTNSELLSLINDMPITNDQKKLMSNNVQIVRQQSYSIMSIIKEEVLAYVVQLPLYGV

IDTPCWKLHTSPLCTTNTKEGSNICLTRTDRGWYCDNAGSVSFFPQAETCKVQSNRVFCDTMNSLTLPSEVNLCNVD

IFNPKYDCKIMTSKTDVSSSVITSLGAIVSCYGKTKCTASNKNRGIIKTFSNGCDYVSNKGVDTVSVGNTLYYVNKQ

EGKSLYVKGEPIINFYDPLVFPSDEFDASISQVNEKINQSLAFIRKSDELLHNVNAGKSTTNIMITTIIIVIIVILL

SLIAVGLLLYCKARSTPVTLSKDQLSGINNIAFSN (3) RSV F subtype A (Accession No. CAA26143.1, incorporated by reference
herein in its entirety)
                                                          (SEQ ID NO: 143)
MELLILKANAITTILTAVTFCFASGQNITEEFYQSTCSAVSKGYLSALRTGWYTSVITIELSNIKENKCNGTDAKVK

LIKQELDKYKNAVTELQLLMQSTPATNNRARRELPRFMNYTLNNAKKTNVTLSKKRKRRFLGFLLGVGSAIASGVAV

SKVLHLEGEVNKIKSALLSTNKAVVSLSNGVSVLTSKVLDLKNYIDKQLLPIVNKQSCSISNIETVIEFQQKNNRLL

EITREFSVNAGVTTPVSTYMLTNSELLSLINDMPITNDQKKLMSNNVQIVRQQSYSIMSIIKEEVLAYVVQLPLYGV

IDTPCWKLHTSPLCTTNTKEGSNICLTRTDRGWFCDNAGSVSFFPQAETCKVQSNRVFCDTMNSLTLPSEVNLCNVD

IFNPKYDCKIMTSKTDVSSSVITSLGAIVSCYGKTKCTASNKNRGIIKTFSNGCDYVSNKGVDTVSVGNTLYYVNKQ

EGKSLYVKGEPIINFYDPLVFPSDEFDASISQVNEKINQSLAFIRKSDELLHNVNAGKSTTNIMITTIIIVIIVILL

SLIAVGLLLYCKARSTPVTLSKDQLSGINNIAFSN (4) RSV F subtype B (Accession No. O36634.1, incorporated by reference herein
in its entirety)
                                                          (SEQ ID NO: 144)
MELLIHRLSAIFLTLAINALYLTSSQNITEEFYQSTCSAVSRGYFSALRTGWYTSVITIELSNIKETKCNGTDTKVK

LIKQELDKYKNAVTELQLLMQNTPAANNRARREAPQYMNYTINTTKNLNVSISKKRKRRFLGFLLGVGSAIASGIAV

SKVLHLEGEVNKIKNALLSTNKAVVSLSNGVSVLTSKVLDLKNYINNQLLPIVNQQSCRISNIETVIEFQQKNSRLL

EINREFSVNAGVTTPLSTYMLTNSELLSLINDMPITNDQKKLMSSNVQIVRQQSYSIMSIIKEEVLAYVVQLPIYGV

IDTPCWKLHTSPLCTTNIKEGSNICLTRTDRGWYCDNAGSVSFFPQADTCKVQSNRVFCDTMNSLTLPSEVSLCNTD

IFNSKYDCKIMTSKTDISSSVITSLGAIVSCYGKTKCTASNKNRGIIKTFSNGCDYVSNKGVDTVSVGNTLYYVNKL
```

-continued

EGKNLYVKGEPIINYYDPLVFPSDEFDASISQVNEKINQSLAFIRRSDELLHNVNTGKSTTNIMITTIIIVIIVVLL

SLIAIGLLLYCKAKNTPVTLSKDQLSGINNIAFSK (5) hRSV F subtype B (Accession No. NP_056863.1, incorporated by reference herein in its entirety)

(SEQ ID NO: 145)

MELLIHRLSAIFLTLAINALYLTSSQNITEEFYQSTCSAVSRGYFSALRTGWYTSVITIELSNIKETKCNGTDTKVK

LIKQELDKYKNAVTELQLLMQNTPAANNRARREAPQYMNYTINTTKNLNVSISKKRKRRFLGFLLGVGSAIASGIAV

SKVLHLEGEVNKIKNALLSTNKAVVSLSNGVSVLTSKVLDLKNYINNQLLPIVNQQSCRISNIETVIEFQQKNSRLL

EINREFSVNAGVTTPLSTYMLTNSELLSLINDMPITNDQKKLMSSNVQIVRQQSYSIMSIIKEEVLAYVVQLPIYGV

IDTPCWKLHTSPLCTTNIKEGSNICLTRTDRGWYCDNAGSVSFFPQADTCKVQSNRVFCDTMNSLTLPSEVSLCNTD

IFNSKYDCKIMTSKTDISSSVITSLGAIVSCYGKTKCTASNKNRGIIKTFSNGCDYVSNKGVDTVSVGNTLYYVNKL

EGKNLYVKGEPIINYYDPLVFPSDEFDASISQVNEKINQSLAFIRRSDELLHNVNTGKSTTNIMITTIIIVIIVVLL

SLIAIGLLLYCKAKNTPVTLSKDQLSGINNIAFSK (6) RSV F subtype B (Accession No. AAB82436, incorporated by reference herein in its entirety)

(SEQ ID NO: 146)

MELLIHRLSAIFLTLAINALYLTSSQNITEEFYQSTCSAVSRGYFSALRTGWYTSVITIELSNIKETKCNGTDTKVK

LIKQELDKYKNAVTELQLLMQNTPAANNRARREAPQYMNYTINTTKNLNVSISKKRKRRFLGFLLGVGSAIASGIAV

SKVLHLEGEVNKIKNALLSTNKAVVSLSNGVSVLTSKVLDLKNYINNQLLPIVNQQSCRISNIETVIEFQQKNSRLL

EINREFSVNAGVTTPLSTYMLTNSELLSLINDMPITNDQKKLMSSNVQIVRQQSYSIMSIIKEEVLAYVVQLPIYGV

IDTPCWKLHTSPLCTTNIKEGSNICLTRTDRGWYCDNAGSVSFFPQADTCKVQSNRVFCDTMNSLTLPSEVSLCNTD

IFNSKYDCKIMTSKTDISSSVITSLGAIVSCYGKTKCTASNKNRGIIKTFSNGCDYVSNKGVDTVSVGNTLYYVNKL

EGKNLYVKGEPIINYYDPLVFPSDEFDASISQVNEKINQSLAFIRRSDELLHNVNTGKSTTNIMITTIIIVIIVVLL

SLIAIGLLLYCKAKNTPVTLSKDQLSGINNIAFSK (7) Bovine RSV F (Accession No. P29791.1, incorporated by reference herein in its entirety)

(SEQ ID NO: 147)

MATTTMRMIISIILISTYVPHITLCQNITEEFYQSTCSAVSRGYLSALRTGWYTSVVTIELSKIQKNVCNGTDSKVK

LIKQELERYNNAVAELQSLMQNEPTSSSRAKRGIPESIHYTRNSTKKFYGLMGKKRKRRFLGFLLGIGSAIASGVAV

SKVLHLEGEVNKIKNALLSTNKAVVSLSNGVSVLTSKVLDLKNYIDKELLPKVNNHDCRISNIATVIEFQQKNNRLL

EIAREFSVNAGITTPLSTYMLTNSELLSIINDMPITNDQKKLMSVCQIVRQQSYSIMSVLREVIAYVVQLPLYGVID

TPCWKLHTSPLCTTDNKEGSNICLTRTDRGWYCDNAGSVSFFPQAETCKVQSNRVFCDTMNSLTLPTDVNLCNTDIF

NSKYDCKIMTSKTDISSSVITSIGAIVSCYGKTKCTASNKNRGIIKTFSNGCDYVSNKGVDTVSVGNTLYYVNKLEG

KALYIKGEPIINYYNPLVFPSDEFDASIAQVNAKINQSLAFIRRSDELLHSVDVGKSTTNVVITTIIIVIVVVILML

ITVGLLFYCKTRSTPIMLGKDQLSSINNLSFSK (8) Bovine RSV F (Accession No. P22167.1, incorporated by reference herein in its entirety)

(SEQ ID NO: 148)

MAATAMRMIISIIFISTYMTHITLCQNITEEFYQSTCSAVSRGYLSALRTGWYTSVVTIELSKIQKNVCKSTDSKVK

LIKQELERYNNAVIELQSLMQNEPASFSRAKRGIPELIHYTRNSTKRFYGLMGKKRKRRFLGFLLGIGSAIASGVAV

SKVLHLEGEVNKIKNALLSTNKAVVSLSNGVSVLTSKVLDLKNYIDKELLPKVNNHDCRISNIETVIEFQQKNNRLL

EIAREFSVNAGITTPLSTYMLTNSELLSLINDMPITNDQKKLMSSNVQIVRQQSYSIMSVVKEEVIAYVVQLPIYGV

IDTPCWKLHTSPLCTTDNKEGSNICLTRTDRGWYCDNAGSVSFFPQAETCKVQSNRVFCDTMNSLTLPTDVNLCNTD

IFNTKYDCKIMTSKTDISSSVITSIGAIVSCYGKTKCTASNKNRGIIKTFSNGCDYVSNKGVDTVSVGNTLYYVNKL

EGKALYIKGEPIINYYDPLVFPSDEFDASIAQVNAKINQSLAFIRRSDELLHSVDVGKSTTNVVITTIIIVIVVVIL

MLIAVGLLFYCKTRSTPIMLGKDQLSGINNLSFSK

The ectodomain of any of the above RSV F protein sequences can be included on a recombinant insect ferritin heavy or light chain fusion protein to generate a recombinant insect ferritin nanoparticle including the RSV F ectodomain in trimeric form. In some embodiments the RSV F ectodomain comprises a F2 polypeptide and an F1 ectodomain including amino acid sequences having at least 75% (for example at least 85%, 90%, 95%, 96%, 97%, 98% or 99%) sequence identity to a corresponding native F2 polypeptide or F1 ectodomain polypeptide sequence (e.g., a native F2 polypeptide or F1 ectodomain sequence from a type A or type B, or bovine RSV F protein), such a native RSV F sequence set forth above. In the recombinant insect ferritin nanoparticle, the signal peptide of the RSV F ectodomain is typically not included as this sequence is removed by proteolytic processing when the ectodomain is expressed in a cell.

In some embodiments, the insect ferritin heavy chain fusion proteins and/or insect ferritin light chain fusion proteins of the recombinant insect ferritin nanoparticle can comprise first or second proteins that are RSV F ectodomains from an RSV type A virus and an RVS type B virus, respectively.

In some embodiments, the recombinant RSV F ectodomain includes an $F_2$ polypeptide comprising or consisting of RSV F positions 26-103, 26-105, or 26-109, and a $F_1$ ectodomain comprising or consisting of RSV F positions 137-511 or 145-511. In some embodiments, the recombinant RSV F ectodomain includes a $F_2$ polypeptide and/or a $F_1$ ectodomain including amino acid sequences at least 75% (for example at least 85%, 90%, 95%, 96%, 97%, 98% or 99%) identical to any one of positions 26-103 and 137-511, respectively; positions 26-105 and 137-511, respectively; positions 26-103 and 145-511, respectively; positions 26-105 and 145-511, respectively; positions 26-109 and 145-511, respectively; of a native subgroup A, B, or Bovine RSV F protein, such the sequence of a RSV F protein set forth above.

In some embodiments, the RSV F ectodomain included on the recombinant insect ferritin nanoparticle can be stabilized in a prefusion conformation by one or more amino acid substitutions. Several amino acid substitutions for stabilizing the RSV F ectodomain in its prefusion conformation are known, including those described in PCT. Pub. No. WO2014/160463, which is incorporated by reference herein in its entirety. Any of the amino acid substitutions disclosed in WO2014/160463 for stabilizing the RSV F ectodomain in its prefusion conformation can be utilized in the embodiments disclosed herein. The amino acid substitutions can, for example, introduce one or more disulfide bonds, fill cavities within the RSV F ectodomain, alter the packing of residues in the RSV F protein, and/or introduce an N-linked glycosylation site, that stabilize the F ectodomain in the prefusion conformation. One example is a recombinant RSV F ectodomain including the "DS-Cav1" substitutions (S155C, S290C, 5190F, V207L).

As noted above, the RSV F protein is initially synthesized as a $F_0$ precursor protein and is cleaved at multiple sites (including two conserved furin cleavage sites) during maturation in eukaryotic cells. Thus, the mature form of the native RSV F protein lacks the N-terminal signal peptide and the pep27 peptide (or a portion thereof) of the $F_0$ precursor protein. In several embodiments, the RSV F ectodomain included on the insect ferritin heavy or light chain fusion protein does not include the signal peptide (or a portion thereof) and/or does not include the pep27 peptide (or a portion thereof). Recombinant RSV F ectodomains lacking the RSV F signal peptide and/or pep27 peptide can be generated by expressing the recombinant $F_0$ polypeptide in cells where the signal peptide and the pep27 peptide will be excised from the $F_0$ precursor by cellular proteases.

In some embodiments, the recombinant RSV F ectodomain is a single chain RSV F ectodomain, including a single polypeptide chain including the $F_2$ polypeptide and the $F_1$ ectodomain. Native RSV F sequences include protease cleavage sites that are cleaved by a cellular protease to generate separate $F_2$, $F_1$, and pep27 polypeptides. The disclosed single chain proteins do not include the cleavage sites separating the $F_2$ polypeptide, the pep27 peptide, and the $F_1$ ectodomain; therefore, when produced in cells, the protomers of the F ectodomain are not cleaved into separate $F_2$ and $F_1$ polypeptide chains. Any amino acid substitution can be used that prevents cleavage of the protomers RSV F into separate $F_2$ and $F_1$ polypeptide chains, and also allows folding of the RSV F ectodomain into its prefusion conformation. In some embodiments, a single chain RSV F ectodomain includes deletion of the two furin cleavage sites, the pep27 polypeptide, and the fusion peptide. In one embodiment, position 103 or position 105 is linked to position 145 of the RSV F ectodomain to generate the single chain construction. In several embodiments, the remaining portions of $F_1$ and $F_2$ are joined by a linker, such as a peptide linker. Non-limiting examples of peptide linkers that can be used include glycine, serine, and glycine-serine linkers.

In some embodiments, the insect ferritin nanoparticle comprises an insect ferritin light chain (e.g., SEQ ID NO: 6) fused to the ectodomain of any of the above RSV F proteins. In some embodiments, the insect ferritin nanoparticle comprises an insect ferritin heavy chain (e.g., SEQ ID NO: 2) fused to the ectodomain of any of the above RSV F proteins. In some embodiments, the insect ferritin nanoparticle comprises an insect ferritin light chain (e.g., SEQ ID NO: 6) fused to the ectodomain of any of the above RSV F proteins, and an insect ferritin heavy chain (e.g., SEQ ID NO: 2) fused to the ectodomain of any of the remaining RSV F proteins listed above. For example, in some embodiments, the insect ferritin nanoparticle comprises an insect ferritin light chain (e.g., SEQ ID NO: 6) and an insect ferritin heavy chain (e.g., SEQ ID NO: 2), or an insect ferritin heavy chain (e.g., SEQ ID NO: 2) and an insect ferritin light chain (e.g., SEQ ID NO: 6), respectively fused to the ectodomains of any one of the following pairs of RSV F proteins noted above: (1) and (2), (1) and (3), (1) and (4), (1) and (5), (1) and (6), (2) and (3), (2) and (4), (2) and (5), (2) and (6), (3) and (4), (3) and (5), (3) and (6), (4) and (5), (4) and (6), (5) and (6), or (7) and (8). In the above pairings of RSV F proteins, the number in parentheses refers to the RSV F proteins listed in this section, for example reference to "(1)" refers to "(1) RSV F subtype A (Accession No. P03420.1)" as shown above. Further, the RSV F ectodomains included in the pairings can be modified as discussed above, for example to be stabilized in a prefusion conformation (e.g., with the DS-Cav1 substitutions), or to be a single chain protein.

Sequences of exemplary insect ferritin heavy and light chain fusion proteins including heavy or light chain ferritin subunits fused to RSV F ectodomains are provided below:

A9835-ds-cav1_fd_8ln_iFerr-L-nt30 (RSV A + ds-cav1 + foldon +
linker + iFerr-L-nt30)

(SEQ ID NO: 149)

QNITEEFYQSTCSAVSKGYLSALRTGWYTSVITIELSNIKENKCNGTDAKVKLIKQELDKYKNAVTELQLLMQSTPA

ANSRARRELPRFMNYTLNNTKNTNVTLSKKRKRRFLGFLLGVGSAIASGIAVcKVLHLEGEVNKIKSALLSTNKAVV

SLSNGVSVLTfKVLDLKNYIDKQLLPIlNKQSCSISNIETVIEFQQKNNRLLEITREFSVNAGVTTPVSTYMLTNSE

LLSLINDMPITNDQKKLMSSNVQIVRQQSYSIMcIIKEEVLAYVVQLPLYGVIDTPCWKLHTSPLCTTNTKEGSNIC

LTRTDRGWYCDNAGSVSFFPQAETCKVQSNRVFCDTMNSLTLPSEVNLCNIDIFNPKYDCKIMTSKTDVSSSVITSL

GAIVSCYGKTKCTASNKNRGIIKTFSNGCDYVSNKGVDTVSVGNTLYYVNKQEGKSLYVKGEPIINFYDPLVFPSDE

FDASISQVNEKINQSLAFIRKSDELLSAIGGYIPEAPRDGQAYVRKDGEWVLLSTFLGGLVPRggsggsgggEYGSHG

NVATELQAYAKLHLERSYDYLLSAAYFNNYQTNRAGFSKLFKKLSDEAWSKTIDIIKHVTKRGDKMNFDQHSTMKTE

RKNYTAENHELEALAKALDTQKELAERAFYIHREATRNSQHLHDPEIAQYLEEEFIEDHAEKIRTLAGHTSDLKKFI

TANNGHDLSLALYVFDEYLQKTV

A9835-ds-cav1_fd_121n_iFerr-L-nt30 (RSV A + ds-cav1 + foldon + linker +
iFerr-L-nt31)

(SEQ ID NO: 150)

QNITEEFYQSTCSAVSKGYLSALRTGWYTSVITIELSNIKENKCNGTDAKVKLIKQELDKYKNAVTELQLLMQSTPA

ANSRARRELPRFMNYTLNNTKNTNVTLSKKRKRRFLGFLLGVGSAIASGIAVcKVLHLEGEVNKIKSALLSTNKAVV

SLSNGVSVLTfKVLDLKNYIDKQLLPIlNKQSCSISNIETVIEFQQKNNRLLEITREFSVNAGVTTPVSTYMLTNSE

LLSLINDMPITNDQKKLMSSNVQIVRQQSYSIMcIIKEEVLAYVVQLPLYGVIDTPCWKLHTSPLCTTNTKEGSNIC

LTRTDRGWYCDNAGSVSFFPQAETCKVQSNRVFCDTMNSLTLPSEVNLCNIDIFNPKYDCKIMTSKTDVSSSVITSL

GAIVSCYGKTKCTASNKNRGIIKTFSNGCDYVSNKGVDTVSVGNTLYYVNKQEGKSLYVKGEPIINFYDPLVFPSDE

FDASISQVNEKINQSLAFIRKSDELLSAIGGYIPEAPRDGQAYVRKDGEWVLLSTFLGGLVPRggsggggsgggsgEY

GSHGNVATELQAYAKLHLERSYDYLLSAAYFNNYQTNRAGFSKLFKKLSDEAWSKTIDIIKHVTKRGDKMNFDQHST

MKTERKNYTAENHELEALAKALDTQKELAERAFYIHREATRNSQHLHDPEIAQYLEEEFIEDHAEKIRTLAGHTSDL

KKFITANNGHDLSLALYVFDEYLQKTV

BE/7004/06-ds-cav1_fd_8ln_iFerr-H-nt19 (RSV B + ds-cav1 + foldon +
linker + iFerr-H-nt19)

(SEQ ID NO: 151)

QNITEEFYQSTCSAVSRGYLSALRTGWYTSVITIELSNIKETKCNGTDTKVKLIKQELDKYKNAVTELQLLMQNTPA

ANNRARREAPQYMNYTINTTKNLNVSISKKRKRRFLGFLLGVGSAIASGIAVcKVLHLEGEVNKIKNALLSTNKAVV

SLSNGVSVLTfKVLDLKNYINNQLLPIlNQQSCRISNIETVIEFQQKNSRLLEITREFSVNAGVTTPLSTYMLTNSE

LLSLINDMPITNDQKKLMSSNVQIVRQQSYSIMcIIKEEVLAYVVQLPIYGVIDTPCWKLHTSPLCTTNIKEGSNIC

LTRTDRGWYCDNAGSVSFFPQADTCKVQSNRVFCDTMNSLTLPSEVSLCNTDIFNSKYDCKIMTSKTDISSSVITSL

GAIVSCYGKTKCTASNKNRGIIKTFSNGCDYVSNKGVDTVSVGNTLYYVNKLEGKNLYVKGEPIINYYDPLVFPSDE

FDASISQVNEKINQSLAFIRRSDELLSAIGGYIPEAPRDGQAYVRKDGEWVLLSTFLGGLVPRggsggsgggRSCRNS

MRQQIQMEVGASLQYLAMGAHFSKDVVNRPGFAQLFFDAASEEREHAMKLIEYLLMRGELTNDVSSLLQVRPPTRSS

WKGGVEALEHALSMESDVTKSIRNVIKACEDDSEFNDYHLVDYLTGDFLEEQYKGQRDLAGKASTLKKLMDRHEALG

EFIFDKKLLGIDV

BE/7004/06-ds-cav1_fd_12ln_iFerr-H-nt19 (RSV B + ds-cav1 + foldon +
linker + iFerr-H-nt19)

(SEQ ID NO: 152)

QNITEEFYQSTCSAVSRGYLSALRTGWYTSVITIELSNIKETKCNGTDTKVKLIKQELDKYKNAVTELQLLMQNTPA

ANNRARREAPQYMNYTINTTKNLNVSISKKRKRRFLGFLLGVGSAIASGIAVcKVLHLEGEVNKIKNALLSTNKAVV

SLSNGVSVLTfKVLDLKNYINNQLLPIlNQQSCRISNIETVIEFQQKNSRLLEITREFSVNAGVTTPLSTYMLTNSE

LLSLINDMPITNDQKKLMSSNVQIVRQQSYSIMcIIKEEVLAYVVQLPIYGVIDTPCWKLHTSPLCTTNIKEGSNIC

LTRTDRGWYCDNAGSVSFFPQADTCKVQSNRVFCDTMNSLTLPSEVSLCNTDIFNSKYDCKIMTSKTDISSSVITSL

-continued

GAIVSCYGKTKCTASNKNRGIIKTFSNGCDYVSNKGVDTVSVGNTLYYVNKLEGKNLYVKGEPIINYYDPLVFPSDE

FDASISQVNEKINQSLAFIRRSDELLSAIGGYIPEAPRDGQAYVRKDGEWVLLSTFLGGLVPRggsggggsggsgRS

CRNSMRQQIQMEVGASLQYLAMGAHFSKDVVNRPGFAQLFFDAASEEREHAMKLIEYLLMRGELTNDVSSLLQVRPP

TRSSWKGGVEALEHALSMESDVTKSIRNVIKACEDDSEFNDYHLVDYLTGDFLEEQYKGQRDLAGKASTLKKLMDRH

EALGEFIFDKKLLGIDV

A9835-ds-cav1_no-fd_11ln_iFerr-L-nt30 (RSV A + ds-cav1 + no foldon + linker + iFerr-L-nt34)

(SEQ ID NO: 153)

QNITEEFYQSTCSAVSKGYLSALRTGWYTSVITIELSNIKENKCNGTDAKVKLIKQELDKYKNAVTELQLLMQSTPA

ANSRARRELPRFMNYTLNNTKNTNVTLSKKRKRRFLGFLLGVGSAIASGIAVcKVLHLEGEVNKIKSALLSTNKAVV

SLSNGVSVLTfKVLDLKNYIDKQLLPI1NKQSCSISNIETVIEFQQKNNRLLEITREFSVNAGVTTPVSTYMLTNSE

LLSLINDMPITNDQKKLMSSNVQIVRQQSYSIMcIIKEEVLAYVVQLPLYGVIDTPCWKLHTSPLCTTNTKEGSNIC

LTRTDRGWYCDNAGSVSFFPQAETCKVQSNRVFCDTMNSLTLPSEVNLCNIDIFNPKYDCKIMTSKTDVSSSVITSL

GAIVSCYGKTKCTASNKNRGIIKTFSNGCDYVSNKGVDTVSVGNTLYYVNKQEGKSLYVKGEPIINFYDPLVFPSDE

FDASISQVNEKINQSLAFIRKSDELLsaiggsggsggEYGSHGNVATELQAYAKLHLERSYDYLLSAAYFNNYQTNR

AGFSKLFKKLSDEAWSKTIDIIKHVTKRGDKMNFDQHSTMKTERKNYTAENHELEALAKALDTQKELAERAFYIHRE

ATRNSQHLHDPEIAQYLEEEFIEDHAEKIRTLAGHTSDLKKFITANNGHDLSLALYVFDEYLQKTV

A9835-ds-cav1_no-fd_15ln_iFerr-L-nt30 (RSV A + ds-cav1 + no foldon + linker + iFerr-L-nt35)

(SEQ ID NO: 154)

QNITEEFYQSTCSAVSKGYLSALRTGWYTSVITIELSNIKENKCNGTDAKVKLIKQELDKYKNAVTELQLLMQSTPA

ANSRARRELPRFMNYTLNNTKNTNVTLSKKRKRRFLGFLLGVGSAIASGIAVcKVLHLEGEVNKIKSALLSTNKAVV

SLSNGVSVLTfKVLDLKNYIDKQLLPI1NKQSCSISNIETVIEFQQKNNRLLEITREFSVNAGVTTPVSTYMLTNSE

LLSLINDMPITNDQKKLMSSNVQIVRQQSYSIMcIIKEEVLAYVVQLPLYGVIDTPCWKLHTSPLCTTNTKEGSNIC

LTRTDRGWYCDNAGSVSFFPQAETCKVQSNRVFCDTMNSLTLPSEVNLCNIDIFNPKYDCKIMTSKTDVSSSVITSL

GAIVSCYGKTKCTASNKNRGIIKTFSNGCDYVSNKGVDTVSVGNTLYYVNKQEGKSLYVKGEPIINFYDPLVFPSDE

FDASISQVNEKINQSLAFIRKSDELLsaiggsggggsggsgEYGSHGNVATELQAYAKLHLERSYDYLLSAAYFNNY

QTNRAGFSKLFKKLSDEAWSKTIDIIKHVTKRGDKMNFDQHSTMKTERKNYTAENHELEALAKALDTQKELAERAFY

IHREATRNSQHLHDPEIAQYLEEEFIEDHAEKIRTLAGHTSDLKKFITANNGHDLSLALYVFDEYLQKTV

BE/7004/06-ds-cav1_no-fd_11ln_iFerr-H-nt19 (RSV B + ds-cav1 + foldon + linker + iFerr-H-nt19

(SEQ ID NO: 155)

QNITEEFYQSTCSAVSRGYLSALRTGWYTSVITIELSNIKETKCNGTDTKVKLIKQELDKYKNAVTELQLLMQNTPA

ANNRARREAPQYMNYTINTTKNLNVSISKKRKRRFLGFLLGVGSAIASGIAVcKVLHLEGEVNKIKNALLSTNKAVV

SLSNGVSVLTfKVLDLKNYINNQLLPI1NQQSCRISNIETVIEFQQKNSRLLEITREFSVNAGVTTPLSTYMLTNSE

LLSLINDMPITNDQKKLMSSNVQIVRQQSYSIMcIIKEEVLAYVVQLPIYGVIDTPCWKLHTSPLCTTNIKEGSNIC

LTRTDRGWYCDNAGSVSFFPQADTCKVQSNRVFCDTMNSLTLPSEVSLCNTDIFNSKYDCKIMTSKTDISSSVITSL

GAIVSCYGKTKCTASNKNRGIIKTFSNGCDYVSNKGVDTVSVGNTLYYVNKLEGKNLYVKGEPIINYYDPLVFPSDE

FDASISQVNEKINQSLAFIRRSDELLsaiggsggsggRSCRNSMRQQIQMEVGASLQYLAMGAHFSKDVVNRPGFAQ

LFFDAASEEREHAMKLIEYLLMRGELTNDVSSLLQVRPPTRSSWKGGVEALEHALSMESDVTKSIRNVIKACEDDSE

FNDYHLVDYLTGDFLEEQYKGQRDLAGKASTLKKLMDRHEALGEFIFDKKLLGIDV

BE/7004/06-ds-cav1_no-fd_15ln_iFerr-H-nt19 (RSV B + ds-cav1 + foldon + linker + iFerr-H-nt19)

(SEQ ID NO: 156)

QNITEEFYQSTCSAVSRGYLSALRTGWYTSVITIELSNIKETKCNGTDTKVKLIKQELDKYKNAVTELQLLMQNTPA

ANNRARREAPQYMNYTINTTKNLNVSISKKRKRRFLGFLLGVGSAIASGIAVcKVLHLEGEVNKIKNALLSTNKAVV

```
SLSNGVSVLTfKVLDLKNYINNQLLPI1NQQSCRISNIETVIEFQQKNSRLLEITREFSVNAGVTTPLSTYMLTNSE

LLSLINDMPITNDQKKLMSSNVQIVRQQSYSIMcIIKEEVLAYVVQLPIYGVIDTPCWKLHTSPLCTTNIKEGSNIC

LTRTDRGWYCDNAGSVSFFPQADTCKVQSNRVFCDTMNSLTLPSEVSLCNTDIFNSKYDCKIMTSKTDISSSVITSL

GAIVSCYGKTKCTASNKNRGIIKTFSNGCDYVSNKGVDTVSVGNTLYYVNKLEGKNLYVKGEPIINYYDPLVFPSDE

FDASISQVNEKINQSLAFIRRSDELLsaiggsggggsggsgRSCRNSMRQQIQMEVGASLQYLAMGAHFSKDVVNRP

GFAQLFFDAASEEREHAMKLIEYLLMRGELTNDVSSLLQVRPPTRSSWKGGVEALEHALSMESDVTKSIRNVIKACE

DDSEFNDYHLVDYLTGDFLEEQYKGQRDLAGKASTLKKLMDRHEALGEFIFDKKLLGIDV
```

Any of the above recombinant insect ferritin light chain fusion proteins can be paired with any of the above recombinant insect ferritin heavy chain fusion proteins to generate a recombinant insect ferritin nanoparticle that display FSV F ectodomains on its surface. In some embodiments, the recombinant insect ferritin nanoparticle can comprise a recombinant insect ferritin light chain fusion protein and a recombinant insect ferritin heavy chain fusion protein respectively comprising one of the following pairs of SEQ ID NOs: 149 and 151, 149 and 152, 149 and 155, 149 and 156, 150 and 151, 150 and 152, 150 and 155, 150 and 156, 153 and 151, 153 and 152, 153 and 155, 153 and 156, 154 and 151, 154 and 152 154 and 155, or 154 and 156.

4. Metapneumovirus (MPV) Ectodomains

In some embodiments, the insect ferritin heavy chain fusion proteins and/or insect ferritin light chain fusion proteins of the recombinant insect ferritin nanoparticle can comprise first or second proteins that are MPV F ectodomains, to produce a recombinant insect ferritin nanoparticle with trimeric MPV F ectodomains on its surface.

MPV is an enveloped non-segmented negative-sense single-stranded RNA virus of the family Paramyxoviridae. It is a common cause of lower respiratory track infections, including bronchiolitis and pneumonia, among children and adults and infects nearly all humans by five years of age. MPV causes repeated infections including severe lower respiratory tract disease, which may occur at any age, especially among the elderly or those with compromised cardiac, pulmonary, or immune systems. The MPV genome includes eight genes encoding nine proteins, including the glycoproteins SH, G and F.

The MPV Fusion (F) protein is an envelope glycoprotein that facilitates fusion of viral and cellular membranes. In nature, the MPV F protein is initially synthesized as a single polypeptide precursor approximately 540 amino acids in length, designated $F_0$. $F_0$ includes an N-terminal signal peptide that directs localization to the endoplasmic reticulum, where the signal peptide (approximately the first 18 residues of $F_0$) is proteolytically cleaved. The remaining $F_0$ residues oligomerize to form a trimer which is again processed at a protease site (between approximately $F_0$ positions 102 and 103; for example, $RQSR_{102}$ (MPV positions 99-102) to generate two disulfide-linked fragments, $F_1$ and $F_2$. The smaller of these fragments, $F_2$, originates from the N-terminal portion of the $F_0$ precursor and includes approximately residues 20-102 of $F_0$. The larger of these fragments, $F_1$, includes the C-terminal portion of the $F_0$ precursor (approximately residues 103-540) including an extracellular/lumenal region (~residues 103-490), a transmembrane domain (~residues 491-513), and a cytoplasmic domain (~residues 514-540) at the C-terminus.

Three $F_2$-$F_1$ protomers oligomerize in the mature MPV F protein, which adopts a metastable "prefusion" conformation that is triggered to undergo a conformational change to a "postfusion" conformation upon contact with a target cell membrane. In the prefusion conformation, the MPV F trimer includes a "cap" at its membrane distal apex, with the three protomers of the F trimer coming together, and the N-terminus of the $F_1$ polypeptide (which includes the fusion peptide that is inserted in to target cell membrane) buried in the core of the F protein trimer. In the postfusion conformation, F protein trimer forms a cylindrical shape, with rearrangements of the fusion peptide extending distally. This conformational change exposes a hydrophobic sequence, known as the fusion peptide, which is located at the N-terminus of the $F_1$ ectodomain, and which associates with the host cell membrane and promotes fusion of the membrane of the virus, or an infected cell, with the target cell membrane. The extracellular portion of the MPV F protein is the MPV F ectodomain, which includes the $F_2$ protein (approximately MPV F positions 20-102) and the $F_1$ ectodomain (approximately MPV F positions 103-490). An MPV F ectodomain trimer includes a protein complex of three MPV F ectodomains.

Two groups of human MPV strains have been described, the A and B groups, which are further divided into subgroups A1, A2, B1, and B2. The disclosed recombinant MPV F proteins can be derived from any group (such as Group A or Group B) or subgroup of MPV, such as subgroup A1, A2, B1, or B2. Native MPV F proteins from different MPV groups, as well as nucleic acid sequences encoding such proteins and methods, are known. For example, the sequence of several exemplary Group A and Group B precursor MPV $F_0$ proteins are provided below:

```
(1) MPV F subtype A1, strain NL/1/00 (Acc. No. AAK62968.2,
incorporated by reference herein)
                                                    (SEQ ID NO: 157)
MSWKVVIIFSLLITPQHGLKESYLEESCSTITEGYLSVLRTGWYTNVFTLEVGDVENLTCADGPSLIKTELDLTKSA

LRELRTVSADQLAREEQIENPRQSRFVLGAIALGVATAAAVTAGVAIAKTIRLESEVTAIKNALKKTNEAVSTLGNG

VRVLATAVRELKDFVSKNLTRAINKNKCDIADLKMAVSFSQFNRRFLNVVRQFSDNAGITPAISLDLMTDAELARAV

SNMPTSAGQIKLMLENRAMVRRKGFGFLIGVYGSSVIYMVQLPIFGVIDTPCWIVKAAPSCSGKKGNYACLLREDQG
```

-continued

```
WYCQNAGSTVYYPNEKDCETRGDHVFCDTAAGINVAEQSKECNINISTTNYPCKVSTGRHPISMVALSPLGALVACY

KGVSCSIGSNRVGIIKQLNKGCSYITNQDADTVTIDNTVYQLSKVEGEQHVIKGRPVSSSFDPVKFPEDQFNVALDQ

VFESIENSQALVDQSNRILSSAEKGNTGFIIVIILIAVLGSTMILVSVFIIIKKTKKPTGAPPELSGVTNNGFIPHN
```

(2) MPV F subtype A2, strain CAN97-83 (Acc. No. Q6WB98, incorporated by reference herein)

(SEQ ID NO: 158)

MSWKVVIIFSLLITPQHGLKESYLEESCSTITEGYLSVLRTGWYTNVFTLEVGDVENLTCSDGPSLIKTELDLTKSA

LRELKTVSADQLAREEQIENPRQSRFVLGAIALGVATAAAVTAGVAIAKTIRLESEVTAIKNALKTTNEAVSTLGNG

VRVLATAVRELKDFVSKNLTRAINKNKCDIDDLKMAVSFSQFNRRFLNVVRQFSDNAGITPAISLDLMTDAELARAV

SNMPTSAGQIKLMLENRAMVRRKGFGILIGVYGSSVIYMVQLPIFGVIDTPCWIVKAAPSCSGKKGNYACLLREDQG

WYCQNAGSTVYYPNEKDCETRGDHVFCDTAAGINVAEQSKECNINISTTNYPCKVSTGRHPISMVALSPLGALVACY

KGVSCSIGSNRVGIIKQLNKGCSYITNQDADTVTIDNTVYQLSKVEGEQHVIKGRPVSSSFDPIKFPEDQFNVALDQ

VFENIENSQALVDQSNRILSSAEKGNTGFIIVIILIAVLGSSMILVSIFIIIKKTKKPTGAPPELSGVTNNGFIPHS (3) MPV F subtype A2, strain NL/17/00 (Acc. No. AY304360.1, incorporated by reference herein)

(SEQ ID NO: 159)

MSWKVVIIFSLLITPQHGLKESYLEESCSTITEGYLSVLRTGWYTNVFTLEVGDVENLTCSDGPSLIKTELDLTKSA

LRELKTVSADQLAREEQIENPRQSRFVLGAIALGVATAAAVTAGVAIAKTIRLESEVTAIKNALKTTNEAVSTLGNG

VRVLATAVRELKDFVSKNLTRAINKNKCDIDDLKMAVSFSQFNRRFLNVVRQFSDNAGITPAISLDLMTDAELARAV

SNMPTSAGQIKLMLENRAMVRRKGFGILIGVYGSSVIYTVQLPIFGVIDTPCWIVKAAPSCSEKKGNYACLLREDQG

WYCQNAGSTVYYPNEKDCETRGDHVFCDTAAGINVAEQSKECNINISTTNYPCKVSTGRHPISMVALSPLGALVACY

KGVSCSIGSNRVGIIKQLNKGCSYITNQDADTVTIDNTVYQLSKVEGEQHVIKGRPVSSSFDPIKFPEDQFNVALDQ

VFENIENSQALVDQSNRILSSAEKGNTGFIIVIILIAVLGSSMILVSIFIIIKKTKKPTGAPPELSGVTNNGFIPHS (4) MPV F subtype A2, strain NCL174 (Acc. No. G0ZRI7, incorporated by reference herein)

(SEQ ID NO: 160)

MSWKVVIIFSLLITPQHSLKESYLEESCSTITEGYLSVLRTGWYTNVFTLEVGDVENLTCADGPSLIKTELDLTKSA

LRELKPVSADQLAREEQIENPRQSRFVLGAIALGVATAAAVTAGVAIAKTIRLESEVTAIKNALKKTNEAVSTLGNG

VRVLATAVRELKDFVSKNLTRAINKNKCDIDDLKMAVSFSQFNRRFLNVVRQFSDNAGITPAISLDLMTDAELARAV

SNMPTAAGQIKLMLENRAMVRRKGFGILIGVYGSSVIYMVQLPIFGVIDTPCWIVKAAPSCSEKKGNYACLLREDQG

WYCQNAGSTVYYPNEKDCETRGDHVFCDTAAGINVAEQSKECNINISTTNYPCKVSTGRHPISMVALSPLGALVACY

KGVSCSIGSNRVGIIKQLNKGCSYITNQDADTVTIDNTVYQLSKVEGEQHVIKGRPVSSSFDPVKFPEDQFNVALDQ

VFENIENSQALVDQSNRILSSAEKGNTGFIIVIILIAVLGSSMILVSVFIIIKKTRKPTGAPPELSGVTNNGFIPHS (5) MPV F subtype B1, strain NL/1/99 (Acc. No. AY304361.1, incorporated by reference herein)

(SEQ ID NO: 161)

MSWKVMIIISLLITPQHGLKESYLEESCSTITEGYLSVLRTGWYTNVFTLEVGDVENLTCTDGPSLIKTELDLTKSA

LRELKTVSADQLAREEQIENPRQSRFVLGAIALGVATAAAVTAGIAIAKTIRLESEVNAIKGALKQTNEAVSTLGNG

VRVLATAVRELKEFVSKNLTSAINRNKCDIADLKMAVSFSQFNRRFLNVVRQFSDNAGITPAISLDLMTDAELARAV

SYMPTSAGQIKLMLENRAMVRRKGFGILIGVYGSSVIYMVQLPIFGVIDTPCWIIKAAPSCSEKNGNYACLLREDQG

WYCKNAGSTVYYPNEKDCETRGDHVFCDTAAGINVAEQSRECNINISTTNYPCKVSTGRHPISMVALSPLGALVACY

KGVSCSIGSNWVGIIKQLPKGCSYITNQDADTVTIDNTVYQLSKVEGEQHVIKGRPVSSSFDPIKFPEDQFNVALDQ

VFESIENSQALVDQSNKILNSAEKGNTGFIIVVILVAVLGLTMISVSIIIIIKKTRKPTGAPPELNGVTNGGFIPHS (6) MPV F subtype B1, strain NDL00-1 (Acc. No. AAK62968.2, incorporated by reference herein)

(SEQ ID NO: 162)

MSWKVVIIFSLLITPQHGLKESYLEESCSTITEGYLSVLRTGWYTNVFTLEVGDVENLTCADGPSLIKTELDLTKSA

LRELRTVSADQLAREEQIENPRQSRFVLGAIALGVATAAAVTAGVAIAKTIRLESEVTAIKNALKKTNEAVSTLGNG

-continued

VRVLATAVRELKDFVSKNLTRAINKNKCDIADLKMAVSFSQFNRRFLNVVRQFSDNAGITPAISLDLMTDAELARAV

SNMPTSAGQIKLMLENRAMVRRKGFGFLIGVYGSSVIYMVQLPIFGVIDTPCWIVKAAPSCSGKKGNYACLLREDQG

WYCQNAGSTVYYPNEKDCETRGDHVFCDTAAGINVAEQSKECNINISTTNYPCKVSTGRHPISMVALSPLGALVACY

KGVSCSIGSNRVGIIKQLNKGCSYITNQDADTVTIDNTVYQLSKVEGEQHVIKGRPVSSSFDPVKFPEDQFNVALDQ

VFESIENSQALVDQSNRILSSAEKGNTGFIIVIILIAVLGSTMILVSVFIIIKKTKKPTGAPPELSGVTNNGFIPHN (7) MPV F subtype B2, strain CAN98-75 (Acc. No. Q6WBA7, incorporated by reference herein)

(SEQ ID NO: 163)

MSWKVMIIISLLITPQHGLKESYLEESCSTITEGYLSVLRTGWYTNVFTLEVGDVENLTCTDGPSLIKTELDLTKSA

LRELKTVSADQLAREEQIENPRQSRFVLGAIALGVATAAAVTAGIAIAKTIRLESEVNAIKGALKTTNEAVSTLGNG

VRVLATAVRELKEFVSKNLTSAINKNKCDIADLKMAVSFSQFNRRFLNVVRQFSDNAGITPAISLDLMTDAELARAV

SYMPTSAGQIKLMLENRAMVRRKGFGILIGVYGSSVIYMVQLPIFGVIDTPCWIIKAAPSCSEKDGNYACLLREDQG

WYCKNAGSTVYYPNKKDCETRGDHVFCDTAAGINVAEQSRECNINISTTNYPCKVSTGRHPISMVALSPLGALVACY

KGVSCSIGSNRVGIIKQLPKGCSYITNQDADTVTIDNTVYQLSKVEGEQHVIKGRPVSSSFDPIKFPEDQFNVALDQ

VFESIENSQALVDQSNKILNSAEKGNTGFIIVIILIAVLGLTMISVSIIIIIKKTRKPTGAPPELNGVTNGGFIPHS

As illustrated by the above sequences, the hMPV F protein exhibits remarkable sequence conservation, with sequence identify of about 90% across hMPV subgroups. In view of the conservation and breadth of knowledge of MPV F sequences, corresponding MPV F amino acid positions between different MPV F strains and subgroups can be readily identified. The numbering of MPV F amino acid substitutions disclosed herein is made with reference to the MPV F protein sequence of the CAN98-75 hMPV strain, unless context indicates otherwise.

The ectodomain of any of the above MPV F protein sequences can be included on a recombinant insect ferritin heavy or light chain fusion protein as described herein to generate a recombinant insect ferritin nanoparticle including the MPV F ectodomain in trimeric form. In some embodiments the MPV F ectodomain comprises a F2 polypeptide and an F1 ectodomain including amino acid sequences having at least 75% (for example at least 85%, 90%, 95%, 96%, 97%, 98% or 99%) identical to a corresponding native MPV $F_2$ or $F_1$ ectodomain polypeptide sequence (e.g., a native $F_2$ or $F_1$ ectodomain polypeptide sequence from a subgroup A1, A2, B1, or B2 MPV F protein), such the sequence of a MPV F protein set forth above.

As noted above, the MPV F protein is initially synthesized as a $F_0$ precursor protein and is cleaved at multiple sites during maturation in eukaryotic cells. Thus, the mature form of the native MPV F protein lacks the N-terminal signal peptide of the $F_0$ precursor protein (for example, the $F_2$ protein typically does not include $F_2$ residues 1-18). Recombinant MPV F proteins lacking the MPV F signal peptide can be generated by expressing the recombinant $F_0$ polypeptide in cells where the signal peptide and the pep27 peptide will be excised from the $F_0$ precursor by cellular proteases.

In additional embodiments, a recombinant MPV F protein includes a $F_2$ polypeptide and/or a $F_1$ ectodomain including one or more amino acid substitutions compared to a corresponding native MPV F sequence.

In some embodiments, the MPV F ectodomain included on the recombinant insect ferritin nanoparticle can be stabilized in a prefusion conformation by one or more amino acid substitutions. Several amino acid substitutions for stabilizing the MPV F ectodomain in its prefusion conformation are known, including those described in PCT App. No. PCT/IB2015/059991, which is incorporated by reference herein in its entirety. Any of the amino acid substitutions disclosed in PCT/IB2015/059991 for stabilizing the MPV F ectodomain in its prefusion conformation can be utilized in the embodiments disclosed herein. The amino acid substitutions can, for example, introduce one or more disulfide bonds, fill cavities within the MPV F ectodomain, alter the packing of residues in the MPV F protein, and/or introduce an N-linked glycosylation site, that stabilize the MPV F ectodomain in the prefusion conformation. One example is a recombinant MPV F ectodomain including a non-natural disulfide bond between A113C and A339C substitutions, and T160F and I177L cavity filling substitutions.

In some embodiments, the recombinant MPV F protein is a single chain MPV F protein, including a single polypeptide chain including the $F_2$ polypeptide and the $F_1$ ectodomain. Native MPV F sequences include a protease cleavage site that is cleaved by a cellular protease to generate separate $F_2$ and $F_1$ polypeptides. The single chain proteins do not include the cleavage site separating the $F_2$ polypeptide and the $F_1$ ectodomain; therefore, when produced in cells, the protomers of the F ectodomain are not cleaved into separate $F_2$ and $F_1$ polypeptide chains. Any amino acid substitution can be used that prevents cleavage of the MPV F into separate $F_2$ and $F_1$ polypeptide chains, and also allows folding of the MPV F ectodomain into its prefusion conformation. In some embodiments, a single chain MPV F ectodomain includes replacement of the furin cleavage site separating the F2 and F1 polypeptides with a peptide linker. Non-limiting examples of peptide linkers that can be used include glycine, serine, and glycine-serine linkers.

III. Polynucleotides and Expression

Polynucleotides encoding a disclosed recombinant insect ferritin heavy chain fusion protein and/or recombinant insect ferritin light chain fusion protein are also provided. These polynucleotides include DNA, cDNA and RNA sequences which encode a disclosed recombinant insect ferritin heavy chain fusion protein and/or recombinant insect ferritin light chain fusion protein. One of skill in the art can readily use the genetic code to construct a variety of functionally equivalent nucleic acids, such as nucleic acids which differ in sequence but which encode the same antibody sequence, or encode a conjugate or fusion protein including the nucleic acid sequence.

In several embodiments, the nucleic acid molecule encodes a precursor of a disclosed recombinant insect ferritin heavy chain fusion protein or recombinant insect ferritin light chain fusion protein, that, when expressed in an appropriate cell, is expressed and processed into a recombinant insect ferritin heavy or light chain fused to a viral envelope protein ectodomain or recombinant influenza HA stem as described herein. For example, the nucleic acid molecule can encode a recombinant insect ferritin heavy or light chain fusion protein that includes a N-terminal signal peptide for entry into the cellular secretory system that is proteolytically cleaved in the during processing of the recombinant protein in the cell.

Exemplary nucleic acids can be prepared by cloning techniques. Examples of appropriate cloning and sequencing techniques, and instructions sufficient to direct persons of skill through many cloning exercises are known (see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013). Product information from manufacturers of biological reagents and experimental equipment also provide useful information. Such manufacturers include the SIGMA Chemical Company (Saint Louis, Mo.), R&D Systems (Minneapolis, Minn.), Pharmacia Amersham (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie AG, Buchs, Switzerland), Invitrogen (Carlsbad, Calif.), and Applied Biosystems (Foster City, Calif.), as well as many other commercial sources known to one of skill.

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

The polynucleotides encoding a recombinant insect ferritin heavy chain fusion protein or recombinant insect ferritin light chain fusion protein can include a recombinant DNA which is incorporated into a vector (such as an expression vector) into an autonomously replicating plasmid or virus or into the genomic DNA of a prokaryote or eukaryote, or which exists as a separate molecule (such as a cDNA) independent of other sequences. The nucleotides can be ribonucleotides, deoxyribonucleotides, or modified forms of either nucleotide. The term includes single and double forms of DNA.

Polynucleotide sequences encoding a recombinant insect ferritin heavy chain fusion protein or recombinant insect ferritin light chain fusion protein can be operatively linked to expression control sequences. An expression control sequence operatively linked to a coding sequence is ligated such that expression of the coding sequence is achieved under conditions compatible with the expression control sequences. The expression control sequences include, but are not limited to, appropriate promoters, enhancers, transcription terminators, a start codon (i.e., ATG) in front of a protein-encoding gene, splicing signal for introns, maintenance of the correct reading frame of that gene to permit proper translation of mRNA, and stop codons.

DNA sequences encoding the recombinant insect ferritin heavy chain fusion protein or recombinant insect ferritin light chain fusion protein can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

Hosts include microbial, yeast, insect and mammalian organisms. Methods of expressing DNA sequences having eukaryotic or viral sequences in prokaryotes are well known in the art. Non-limiting examples of suitable host cells include bacteria, archea, insect, fungi (for example, yeast), plant, and animal cells (for example, mammalian cells, such as human). Exemplary cells of use include *Escherichia coli, Bacillus subtilis, Saccharomyces cerevisiae, Salmonella typhimurium*, SF9 cells, C129 cells, 293 cells, *Neurospora*, and immortalized mammalian myeloid and lymphoid cell lines. Techniques for the propagation of mammalian cells in culture are well-known (see, e.g., Helgason and Miller (Eds.), 2012, Basic Cell Culture Protocols (Methods in Molecular Biology), 4$^{th}$ Ed., Humana Press). Examples of commonly used mammalian host cell lines are VERO and HeLa cells, CHO cells, and WI38, BHK, and COS cell lines, although cell lines may be used, such as cells designed to provide higher expression, desirable glycosylation patterns, or other features. In some embodiments, the host cells include HEK293 cells or derivatives thereof, such as GnTI$^{-/-}$ cells (ATCC® No. CRL-3022), or HEK-293F cells.

Transformation of a host cell with recombinant DNA can be carried out by conventional techniques. Where the host is prokaryotic, such as, but not limited to, *E. coli*, competent cells which are capable of DNA uptake can be prepared from cells harvested after exponential growth phase and subsequently treated by the CaCl$_2$ method using procedures well known in the art. Alternatively, MgCl$_2$ or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or viral vectors can be used. Eukaryotic cells can also be co-transformed with polynucleotide sequences encoding a disclosed antigen, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Viral Expression Vectors, Springer press, Muzyczka ed., 2011). One of skill in the art can readily use an expression systems such as plasmids and vectors of use in producing proteins in cells including higher eukaryotic cells such as the COS, CHO, HeLa and myeloma cell lines.

Modifications can be made to a nucleic acid encoding a recombinant insect ferritin heavy chain fusion protein or recombinant insect ferritin light chain fusion protein described herein without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps.

In addition to recombinant methods, the recombinant insect ferritin heavy chain fusion protein or recombinant insect ferritin light chain fusion protein can also be constructed in whole or in part using protein synthesis methods known in the art.

IV. Immunogenic Compositions

Immunogenic compositions comprising a disclosed recombinant insect ferritin nanoparticle and a pharmaceutically acceptable carrier are also provided. Such compositions can be administered to a subject by a variety of modes, for example, by an intranasal route. Standard methods for preparing administrable immunogenic compositions are described, for example, in such publications as *Remingtons Pharmaceutical Sciences*, 19$^{th}$ Ed., Mack Publishing Company, Easton, Pa., 1995.

The immunogenic compositions can be formulated for administration to a subject by a variety of administration modes, including mucosal administration modes such as by oral, rectal, intranasal, intrapulmonary, or transdermal delivery, or by topical delivery to other surfaces, and non-mucosal routes, including by intramuscular, subcutaneous, intravenous, intra-arterial, intra-articular, intraperitoneal, or parenteral routes.

Potential carriers include, but are not limited to, physiologically balanced culture medium, phosphate buffer saline solution, water, emulsions (e.g., oil/water or water/oil emulsions), various types of wetting agents, cryoprotective additives or stabilizers such as proteins, peptides or hydrolysates (e.g., albumin, gelatin), sugars (e.g., sucrose, lactose, sorbitol), amino acids (e.g., sodium glutamate), or other protective agents. The resulting aqueous solutions may be packaged for use as is or lyophilized. Lyophilized preparations are combined with a sterile solution prior to administration for either single or multiple dosing.

The immunogenic composition can contain a bacteriostat to prevent or minimize degradation during storage, including but not limited to effective concentrations (usually 1% w/v) of benzyl alcohol, phenol, m-cresol, chlorobutanol, methylparaben, and/or propylparaben. A bacteriostat may be contraindicated for some patients; therefore, a lyophilized formulation may be reconstituted in a solution either containing or not containing such a component.

The immunogenic composition can contain as pharmaceutically acceptable vehicles substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, and triethanolamine oleate.

In certain embodiments, the recombinant insect ferritin nanoparticles can be administered in a time-release formulation, for example in a immunogenic composition that includes a slow release polymer. These compositions can be prepared with vehicles that will protect against rapid release, for example a controlled release vehicle such as a polymer, microencapsulated delivery system or bioadhesive gel. Prolonged delivery in various compositions of the disclosure can be brought about by including in the composition agents that delay absorption, for example, aluminum monostearate hydrogels and gelatin. When controlled release formulations are desired, controlled release binders suitable for use in accordance with the disclosure include any biocompatible controlled release material which is inert to the active agent and which is capable of incorporating the vaccine and/or other biologically active agent. Numerous such materials are known in the art. Useful controlled-release binders are materials that are metabolized slowly under physiological conditions following their delivery (for example, at a mucosal surface, or in the presence of bodily fluids). Appropriate binders include, but are not limited to, biocompatible polymers and copolymers well known in the art for use in sustained release formulations. Such biocompatible compounds are non-toxic and inert to surrounding tissues, and do not trigger significant adverse side effects, such as nasal irritation, immune response, inflammation, or the like. They are metabolized into metabolic products that are also biocompatible and easily eliminated from the body.

The immunogenic composition may optionally include an adjuvant to enhance the immune response of the host. Suitable adjuvants are, for example, toll-like receptor agonists, alum, AlPO4, alhydrogel, Lipid-A and derivatives or variants thereof, oil-emulsions, saponins, neutral liposomes, liposomes containing the recombinant virus, and cytokines, non-ionic block copolymers, and chemokines. Non-ionic block polymers containing polyoxyethylene (POE) and polyxylpropylene (POP), such as POE-POP-POE block copolymers, MPL™ (3-O-deacylated monophosphoryl lipid A; Corixa, Hamilton, Ind.) and IL-12 (Genetics Institute, Cambridge, Mass.), among many other suitable adjuvants well known in the art, may be used as an adjuvant (Newman et al., 1998, *Critical Reviews in Therapeutic Drug Carrier Systems* 15:89-142). These adjuvants have the advantage in that they help to stimulate the immune system in a non-specific way, thus enhancing the immune response to a pharmaceutical product.

In some embodiments, the immunogenic composition can be provided in unit dosage form for use to induce an immune response in a subject, for example, to prevent or inhibit HIV-1 or influenza infection in the subject. A unit dosage form contains a suitable single preselected dosage for administration to a subject, or suitable marked or measured multiples of two or more preselected unit dosages, and/or a metering mechanism for administering the unit dose or multiples thereof.

The immunogenic composition typically contains a effective amount of a disclosed recombinant insect ferritin nanoparticles, and can be prepared by conventional techniques. Preparation of immunogenic compositions, including those for administration to human subjects, is generally described in Pharmaceutical Biotechnology, Vol. 61 Vaccine Design—the subunit and adjuvant approach, edited by Powell and Newman, Plenum Press, 1995. New Trends and Developments in Vaccines, edited by Voller et al., University Park Press, Baltimore, Md., U.S.A. 1978. Typically, the amount of antigen in each dose of the immunogenic composition is selected as an amount which induces an immune response without significant adverse side effects.

The amount of the disclosed recombinant insect ferritin nanoparticles included in the therapeutic composition can vary depending upon the specific antigen employed, the route and protocol of administration, and the target population, for example. For protein therapeutics, typically, each human dose will comprise 1-1000 μg of protein, such as from about 1 μg to about 100 μg, for example, from about 1 μg to about 50 μg, such as about 1 μg, about 2 μg, about 5 μg, about 10 μg, about 15 μg, about 20 μg, about 25 μg, about 30 μg, about 40 μg, or about 50 μg. The amount utilized in an immunogenic composition is selected based on the subject population (e.g., infant or elderly). An optimal amount for a particular composition can be ascertained by standard studies involving observation of antibody titers and other responses in subjects. It is understood that a therapeutically effective amount of a disclosed recombinant insect ferritin nanoparticle comprises an amount that is ineffective at eliciting an immune response by administration of a single dose, but that is effective upon administration of multiple dosages, for example in a prime-boost administration protocol.

V. Methods of Eliciting an Immune Response

The disclosed recombinant insect ferritin nanoparticles can be administered to a subject to elicit an immune response to the trimeric antigens included on the recombinant insect ferritin nanoparticle in the subject. Upon immunization, the subject responds by producing antibodies specific for the two different trimeric antigens on the recombinant insect ferritin nanoparticle. In addition, innate and cell-mediated immune responses are induced, which can provide antiviral effectors as well as regulating the immune response. The immune response can be a protective immune response, for example a response that prevents or reduces subsequent infection with a virus including the trimeric antigen. The immune response can be a therapeutic immune response, for example a response that treats or inhibits current infection with a virus including the trimeric antigen and illnesses associated therewith.

Typical subjects intended for treatment with the compositions and methods of the present disclosure include humans, as well as non-human primates and other animals. To identify subjects for prophylaxis or treatment according to the methods of the disclosure, accepted screening methods are employed to determine risk factors associated with a targeted or suspected disease of condition, or to determine the status of an existing disease or condition in a subject. These screening methods include, for example, conventional work-ups to determine environmental, familial, occupational, and other such risk factors that may be associated with the targeted or suspected disease or condition, as well as diagnostic methods, such as various ELISA and other immunoassay methods. These and other routine methods allow the clinician to select patients in need of therapy using the methods and imunogenic compositions of the disclosure. In accordance with these methods and principles, a recombinant insect ferritin nanoparticle and/or other biologically active agent can be administered according to the teachings herein as an independent prophylaxis or treatment program, or as a follow-up, adjunct or coordinate treatment regimen to other treatments.

In some embodiments, a subject is selected for treatment that has, or is at risk for developing, an HIV-1 infection, for example because of exposure or the possibility of exposure to HIV-1. Such a subject can then be administered an effective amount of a recombinant insect ferritin nanoparticle including trimeric antigens that are trimeric HIV-1 Env ectodomains to induce an immune response to HIV-1 Env. The immune response can neutralize autologous virus (e.g., the strain for the trimeric antigens on the nanoparticle) or heterologous virus (e.g., strains other than the strain of the trimeric antigen on the nanoparticle). In some such embodiments, the immune response inhibits subsequent HIV-1 infection (for example, as measured by infection of cells, or by number or percentage of subjects infected by HIV-1) by a desired amount, for example by at least 10%, at least 20%, at least 50%, at least 60%, at least 70%, at least 80%, at least 90%, at least 95%, at least 98%, or even at least 100% (prevention of detectable HIV-1 infection), as compared to a suitable control.

In some embodiments, a subject is selected for treatment that has, or is at risk for developing, an influenza infection, for example because of exposure or the possibility of exposure to influenza. Such a subject can then be administered an effective amount of a recombinant insect ferritin nanoparticle including trimeric antigens that are trimeric influenza HA ectodomains or recombinant influenza HA stems. The immune response can neutralize autologous virus (e.g., the strain for the trimeric antigens on the nanoparticle) or heterologous virus (e.g., strains other than the strain of the trimeric antigen on the nanoparticle). In some such embodiments, the immune response inhibits subsequent influenza infection (for example, as measured by infection of cells, or by number or percentage of subjects infected by influenza) by a desired amount, for example by at least 10%, at least 20%, at least 50%, at least 60%, at least 70%, at least 80%, at least 90%, at least 95%, at least 98%, or even at least 100% (prevention of detectable influenza infection), as compared to a suitable control.

In some embodiments, a subject is selected for treatment that has, or is at risk for developing, an RSV infection, for example because of exposure or the possibility of exposure to RSV. Such a subject can then be administered an effective amount of a recombinant insect ferritin nanoparticle including trimeric antigens that are trimeric RSV F ectodomains. The immune response can neutralize autologous virus (e.g., the strain for the trimeric antigens on the nanoparticle) or heterologous virus (e.g., strains other than the strain of the trimeric antigen on the nanoparticle). In some such embodiments, the immune response inhibits subsequent RSV infection (for example, as measured by infection of cells, or by number or percentage of subjects infected by RSV) by a desired amount, for example by at least 10%, at least 20%, at least 50%, at least 60%, at least 70%, at least 80%, at least 90%, at least 95%, at least 98%, or even at least 100% (prevention of detectable RSV infection), as compared to a suitable control.

In some embodiments, a subject is selected for treatment that has, or is at risk for developing, an MPV infection, for example because of exposure or the possibility of exposure to MPV. Such a subject can then be administered an effective amount of a recombinant insect ferritin nanoparticle including trimeric antigens that are trimeric MPV F ectodomains. The immune response can neutralize autologous virus (e.g., the strain for the trimeric antigens on the nanoparticle) or heterologous virus (e.g., strains other than the strain of the trimeric antigen on the nanoparticle). In some such embodiments, the immune response inhibits subsequent MPV infection (for example, as measured by infection of cells, or by number or percentage of subjects infected by MPV) by a desired amount, for example by at least 10%, at least 20%, at least 50%, at least 60%, at least 70%, at least 80%, at least 90%, at least 95%, at least 98%, or even at least 100% (prevention of detectable MPV infection), as compared to a suitable control.

In some embodiments, when used to prevent or treat a viral infection (such as HIV-1, influenza, RSV, and/or MPV infection), the recombinant insect ferritin nanoparticle comprises trimeric antigens from a virus of interest (such as two different HIV-1 Env ectodomain trimers, two different influenza HA ectodomain trimers, two different recombinant influenza HA stems, two different RSV F ectodomain trimers, or two different MPV F ectodomain trimers) and administration of an effective amount the recombinant insect ferritin nanoparticle to a subject induces an immune response in the subject that neutralizes the relevant virus.

The immunogenic composition may be administered by any suitable method, including but not limited to, via injection, aerosol delivery, nasal spray, nasal droplets, oral inoculation, or topical application.

An effective amount of the recombinant insect ferritin nanoparticle and/or other biologically active agent is administered to a subject in need of such treatment for a time and under conditions sufficient to prevent, inhibit, and/or ameliorate a selected disease or condition or one or more symptom(s) thereof.

The recombinant insect ferritin nanoparticle can be administered to the subject in a single bolus delivery, via continuous delivery (for example, continuous transdermal, mucosal or intravenous delivery) over an extended time period, or in a repeated administration protocol (for example, by an hourly, daily or weekly, repeated administration protocol). The effective amount of the recombinant insect ferritin nanoparticle can be provided as repeated doses within a prolonged prophylaxis or treatment regimen that will yield clinically significant results to alleviate one or more symptoms or detectable conditions associated with a targeted disease or condition as set forth herein.

The administration of an effective amount of a recombinant insect ferritin nanoparticle of the disclosure can be for either prophylactic or therapeutic purpose. When provided prophylactically, the recombinant insect ferritin nanoparticle is provided in advance of any symptom, for example in advance of infection, such as in the form of a yearly flu shot. The prophylactic administration of the recombinant insect ferritin nanoparticle serves to prevent or ameliorate any subsequent infection. When provided therapeutically, the recombinant insect ferritin nanoparticle is provided at (or shortly after) the onset of a symptom of disease or infection. Thus, when used to prevent or treat a viral infection (such as HIV-1, influenza, RSV, and/or MPV infection), the recombinant insect ferritin nanoparticle of the disclosure can be provided prior to the anticipated exposure to virus so as to attenuate the anticipated severity, duration or extent of an infection and/or associated disease symptoms, after exposure or suspected exposure to the virus, or after the actual initiation of an infection.

Determination of effective dosages is typically based on animal model studies followed up by human clinical trials and is guided by administration protocols that significantly reduce the occurrence or severity of targeted disease symptoms or conditions in the subject. Suitable models in this regard include, for example, murine, rat, porcine, feline, ferret, non-human primate, and other accepted animal model subjects known in the art. Alternatively, effective dosages can be determined using in vitro models (for example, immunologic and histopathologic assays). Using such models, only ordinary calculations and adjustments are required to determine an appropriate concentration and dose to administer a therapeutically effective amount of the recombinant insect ferritin nanoparticle (for example, amounts that are effective to elicit a desired immune response or alleviate one or more symptoms of a targeted disease).

The actual dosage of the recombinant insect ferritin nanoparticle will vary according to factors such as the disease indication and particular status of the subject (for example, the subject's age, size, fitness, extent of symptoms, susceptibility factors, and the like), time and route of administration, other drugs or treatments being administered concurrently, as well as the specific pharmacology of the vaccine for eliciting the desired activity or biological response in the subject. Dosage regimens can be adjusted to provide an optimum prophylactic or therapeutic response. As described above in the forgoing listing of terms, a therapeutically effective amount is also one in which any toxic or detrimental side effects of the recombinant insect ferritin nanoparticle and/or other biologically active agent is outweighed in clinical terms by therapeutically beneficial effects. A non-limiting range for a therapeutically effective amount of a recombinant insect ferritin nanoparticle and/or other biologically active agent within the methods and formulations of the disclosure is about 0.01 mg/kg body weight to about 10 mg/kg body weight, such as about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.5 mg/kg, about 2 mg/kg, about 2.5 mg/kg, about 3 mg/kg, about 4 mg/kg, about 5 mg/kg, or about 10 mg/kg, for example 0.01 mg/kg to about 1 mg/kg body weight, about 0.05 mg/kg to about 5 mg/kg body weight, about 0.2 mg/kg to about 2 mg/kg body weight, or about 1.0 mg/kg to about 10 mg/kg body weight. In some embodiments, the dosage includes a set amount of a disclosed recombinant insect ferritin nanoparticle, such as from about 1-300 μg, for example, a dosage of about 10-300 μg, about 60 μg, about 1, 2, 3, 4, 5, 6, 7, 8, 9, 10, 15, 20, 30, 40, 50, 60, 70, 80, 90, 100, 150, 200, 250, or about 300 μg. As used herein with reference to a concentration or amount, "about" refers to +/−5%. Therefore, "about 100 μg" refers to 95-105 μg.

Upon administration of an effective amount of a disclosed recombinant insect ferritin nanoparticle (for example, via injection, aerosol, oral, topical or other route), the immune system of the subject typically responds to the recombinant insect ferritin nanoparticle by producing antibodies specific for the trimeric antigens on the recombinant insect ferritin nanoparticle. Such a response signifies that an effective amount of the recombinant insect ferritin nanoparticle was delivered. An effective amount can be achieved by single or multiple administrations (including, for example, multiple administrations per day), daily, or weekly administrations. For each particular subject, specific dosage regimens can be evaluated and adjusted over time according to the individual need and professional judgment of the person administering or supervising the administration of the vaccine. In some embodiments, the antibody response of a subject administered the compositions of the disclosure will be determined in the context of evaluating effective dosages/immunization protocols. In most instances it will be sufficient to assess the antibody titer in serum or plasma obtained from the subject. Decisions as to whether to administer booster inoculations and/or to change the amount of the composition administered to the individual can be at least partially based on the antibody titer level. The antibody titer level can be based on, for example, an immunobinding assay which measures the concentration of antibodies in the serum which bind to a specific antigen, for example, influenza HA protein.

An immunogenic composition including one or more of the disclosed recombinant insect ferritin nanoparticle can be used in coordinate (or prime-boost) vaccination protocols or combinatorial formulations. In certain embodiments, novel combinatorial immunogenic compositions and coordinate immunization protocols employ separate recombinant insect ferritin nanoparticle or formulations, each directed toward eliciting an anti-viral immune response, such as an immune response to HIV-1 Env proteins. Separate immunogenic compositions that elicit the anti-viral immune response can be combined in a polyvalent immunogenic composition administered to a subject in a single immunization step, or they can be administered separately (in monovalent immunogenic compositions) in a coordinate (or prime-boost) immunization protocol.

There can be several boosts, and each boost can be a different disclosed immunogen. In some examples that the boost may be the same immunogen as another boost, or the prime. The prime and boost can be administered as a single dose or multiple doses, for example two doses, three doses, four doses, five doses, six doses or more can be administered to a subject over days, weeks or months. Multiple boosts can also be given, such one to five (e.g., 1, 2, 3, 4 or 5 boosts), or more. Different dosages can be used in a series of sequential immunizations. For example a relatively large dose in a primary immunization and then a boost with relatively smaller doses.

In some embodiments, the boost can be administered about two, about three to eight, or about four, weeks following the prime, or about several months after the prime. In some embodiments, the boost can be administered about 5, about 6, about 7, about 8, about 10, about 12, about 18, about 24, months after the prime, or more or less time after the prime. Periodic additional boosts can also be used at appropriate time points to enhance the subject's "immune memory."

The adequacy of the vaccination parameters chosen, e.g., formulation, dose, regimen and the like, can be determined by taking aliquots of serum from the subject and assaying antibody titers and/or neutralizing activity during the course of the immunization program. To assess neutralization activity, following immunization of a subject, serum can be collected from the subject at appropriate time points, frozen, and stored for neutralization testing. Methods to assay for neutralization activity are known and are further described herein, and include, but are not limited to, plaque reduction neutralization (PRNT) assays, microneutralization assays, flow cytometry based assays, single-cycle infection assays. In some embodiments, the serum neutralization activity can be assayed using a panel of pseudoviruses. In addition, the clinical condition of the subject can be monitored for the desired effect. If such monitoring indicates that vaccination is sub-optimal, the subject can be boosted with an additional dose of immunogenic composition, and the vaccination parameters can be modified in a fashion expected to potentiate the immune response. Thus, for example, the dose of the disclosed immunogen can be increased or the route of administration can be changed.

EXAMPLES

The following examples are provided to illustrate particular features of certain embodiments, but the scope of the claims should not be limited to those features exemplified.

Example 1

Two-Component Ferritin Nanoparticles for Multimerization of Diverse Trimeric Antigens This example illustrates a novel approach for the multimerization of a viral antigen on a self-assembling ferritin nanoparticle that can improve breadth and potency of the elicited neutralizing antibody responses. Ferritin variants are disclosed that allow the attachment of two diverse trimeric antigens in a regular geometric pattern. Formation of this two-component ferritin was confirmed for antigens derived from HIV-1 Env and influenza HA, highlighting the potential utility of these self-assembling nanoparticles as a general technology for multimerization of diverse antigens.

The presentation of viral antigens in a regular repetitive pattern on the surface of virus particles facilitates B-cell activation (Bachmann & Zinkernagel, *Ann. Rev. Immunol.*, 15, 235-270, 1997; Hinton et al., *Curr. topics microbiol. Immunol.*, 319, 1-15, 2008; Bachmann & Jennings, *Nat Rev Immunol*, 10, 787-796, 2010). Multimerization of antigens on engineered particles that mimic the geometric patterns observed for native viral proteins can lead to improved antibody responses (Bachmann et al. *Science*, 262, 1448-1451, 1993; Dintzis et al., *PNAS*, 73, 3671-3675, 1976; Zhao et al., *Vaccine*, 32, 327-337, 2014). Recently, ferritin, a self-assembling sphere-like nanoparticle consisting of 24 copies of a single protein, was used for the multimerization of influenza hemagglutinin (HA) antigens, resulting in the elicitation of antibodies with substantially improved neutralization breadth and potency in immunized animals (Kanekiyo et al., *Nature* 499, 102-106, 2013).

Figure 1A:
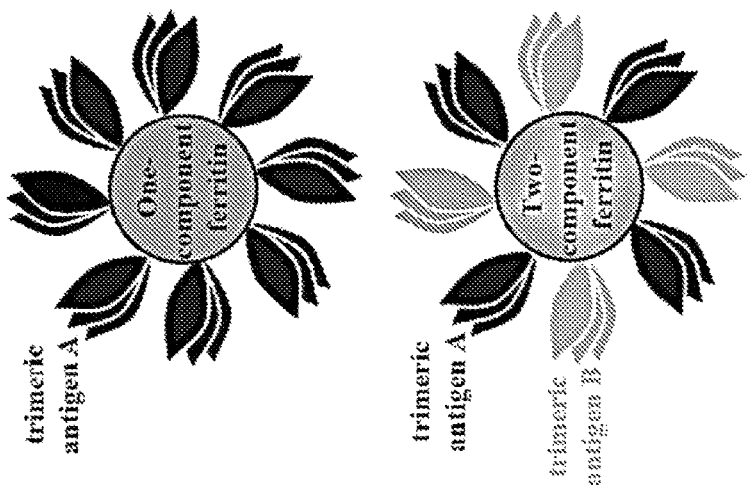

In the bacterial ferritin-antigen formulation, an antigen is genetically fused to the N-terminus of each of the 24 copies of the ferritin protein, allowing the formation of outward-facing spike-like structures, which in the case of influenza HA assemble into eight trimer spikes (FIG. 1A). The bacterial ferritin technology, however, can only permit the random co-assembly of diverse antigens (by, e.g., co-expressing multiple ferritin-antigen genes) and cannot guarantee the pattern and ratio of each antigen on a single particle. This example provides a two-component ferritin that allows the attachment of two different antigens in a regular geometric pattern and at an equal (1:1) ratio. The designs are tailored for the presentation of trimeric antigens, which makes this technology especially applicable to viruses such as HIV-1, where antigens in a native-like trimer, rather than monomer, form are believed to be more optimal as immunogens (Sanders et al., *PLoS pathogens*, 9, e1003618, 2013). These two-component ferritin particles allow the attachment of four trimers each for two distinct antigens. It is shown that two-component ferritin can form with two diverse HIV-1 Env antigens or two diverse influenza HA antigens, as well as both HIV-1 Env and influenza HA antigens displayed on a single two-component ferritin particle.

Figure 7:
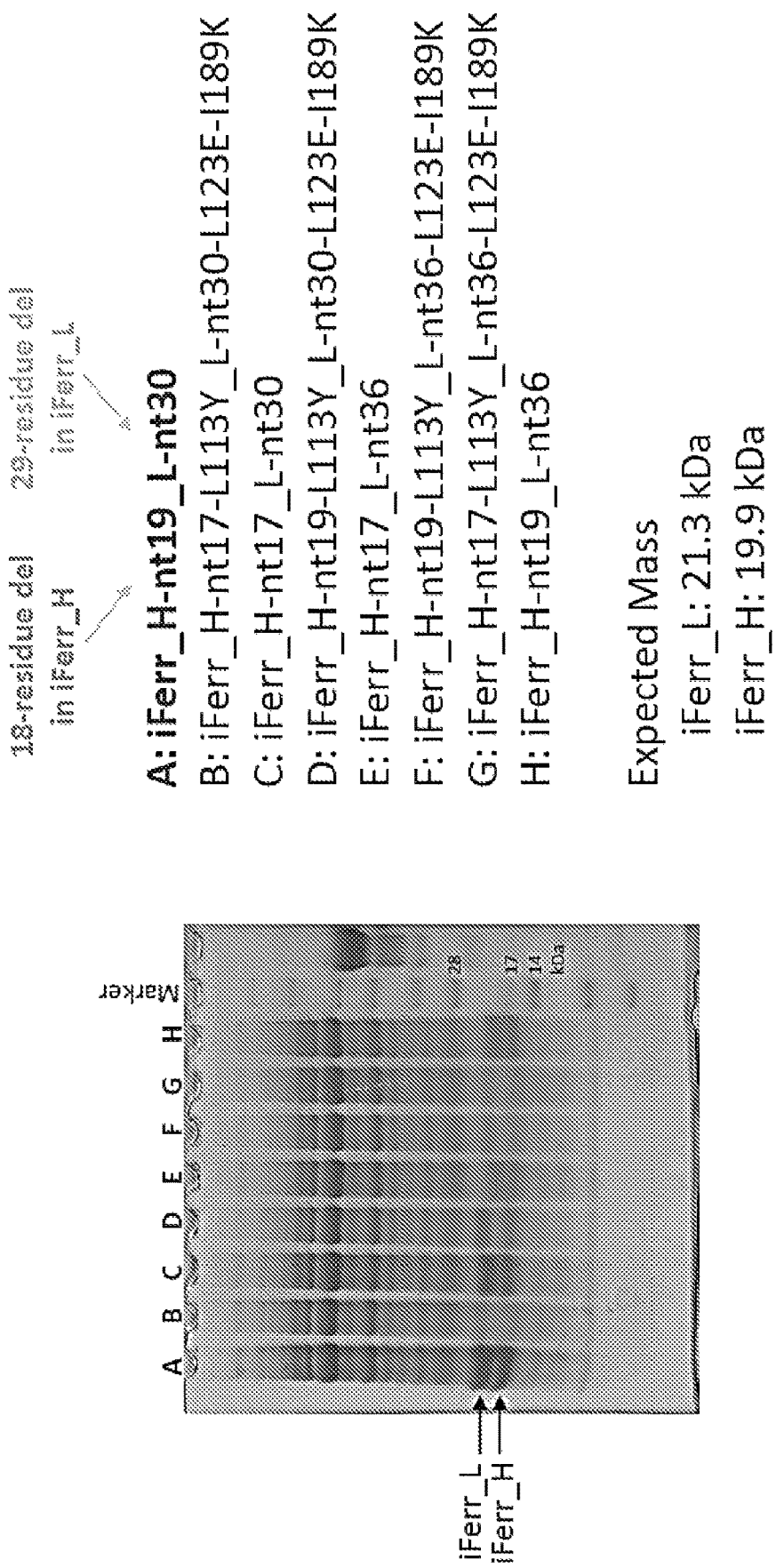
FIG. 7 is coommassie blue stained gel showing expression levels of insect ferritin heavy and light chain proteins with various N-terminal truncations.

To allow the addition of two different antigens on the same particle, a ferritin molecule derived from the insect *Trichoplusia ni* (iFerr) was used since it self-assembles naturally as a 24-mer with twelve copies each of a heavy and light chain (termed iFerr HC and iFerr LC, respectively) (see Hamburger et al., *J mol. Biol.*, 349, 558-569, 2005). However, the location of the N-termini of the wildtype iFerr, is not optimal for attachment of trimeric antigens (FIG. 1B). Hence, the iFerr particle was modified by deleting N-term residues from both iFerr HC and iFerr LC. Several different combinations of N-terminal truncations for the insect ferritin heavy and light chains were tested for expression (FIG. 7). Expression of an iFerr HC with an 18 amino acid N-terminal truncation (SEQ ID NO: 2) and an iFerr LC with a 29 amino acid N-terminal truncation deletion (SEQ ID NO: 6) produced substantially higher expression compared to other combinations of heavy and light chain N-terminal truncations (FIG. 7). The SEQ ID NO: 2 and SEQ ID NO: 6 iFerr heavy and light chains resulted in antigen attachment points on the ferritin particle that formed an equilateral triangle with distances of ~34 Å (HC) and ~31 Å (LC) (FIG. 1B), in line with the close to 30 Å distance between the C-term attachment points for influenza HA and HIV-1 Env. To determine whether these residue deletions would destabilize and affect the formation of the ferritin particles, negative-stain electron microscopy (EM) were performed. Globular particles with a diameter of 145±11 Å were observed, indicating that iFerr particles could successfully form even with N-term deletions in both chains (FIG. 1C).

Figure 3:
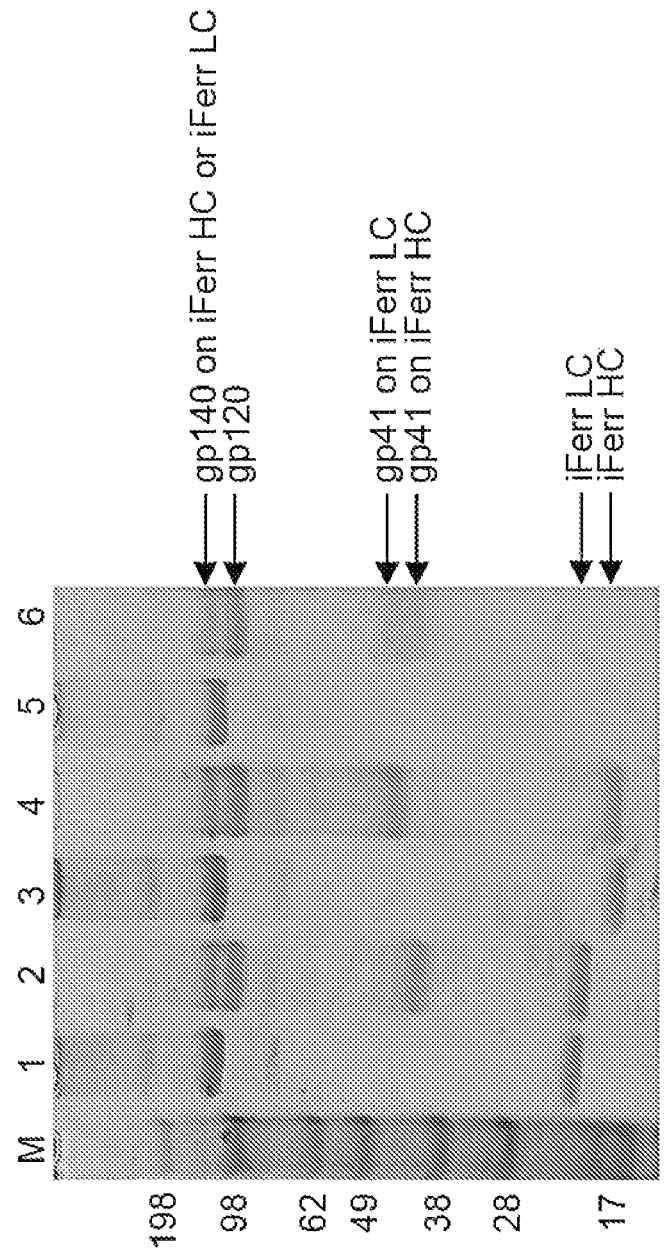
FIG. 3 shows an SDS-PAGE of recombinant insect ferritin nanoparticles. Lane M: molecular weight marker. Lanes 1-2: antigen on iFerr HC only (1: non-reduced, NR; 2: reduced, R); Lanes 3-4: antigen on iFerr LC only (3-NR; 4-R); Lanes 5-6: antigen on both iFerr HC and iFerr LC (5-NR; 6-R).

Next, it was determined whether antigens can be added properly to each of the iFerr chains (SEQ ID NO: 2 and SEQ ID NO: 6). To that end, particles where antigen was attached to iFerr HC only (SEQ ID NO: 2, with no antigen on iFerr LC), to iFerr LC only (SEQ ID NO: 6, with no antigen on iFerr HC), or to both iFerr HC and LC (SEQ ID NOs: 2 and 4), were tested (FIG. 3). As antigen, a soluble gp140 trimer based on the HIV-1 Clade C strain CNE58 was used (Shang et al., J. biol. Chem., 286, 14531-14541, 2011). The CNE58 sequence (ectodomain of SEQ ID NO: 20) was linked to the N-terminus of the heavy or light chain ferritin sequence (SEQ ID NO: 2 or 4) by a 5 amino acid peptide linker (residues 651-655 of SEQ ID NO: 26). Negative-stain EM confirmed the formation of the particles in all three cases (FIG. 1D). Of note, the particles with antigen on both HC and LC had visibly more spikes than the particles with antigens on only one of the two chains, highlighting the importance of utilizing both iFerr chains for the assembly of particles with a full assortment of (eight) spikes (FIG. 1D).

To determine whether iFerr particles could form when two different antigens were attached to, respectively, iFerr HC and LC, particles with two diverse HIV-1 strains (dual-HIV iFerr): soluble gp140 based on strain CNE58 on iFerr LC (as discussed above, a fusion of CNE8 (SEQ ID NO: 20) ectodomain and SEQ ID NO: 6 via the five amino acid peptide linker) and another clade-C strain, ZM106 (on iFerr HC, Derdeyn et al., Science 303, 2019-2022, 2004; a fusion of ZM106 ectodomain and SEQ ID NO: 2 via the five amino acid peptide linker) were tested (FIG. 2A). Two SEC peaks were observed, with the first peak attributed to higher-order particle formation, and the second peak possibly attributed to free (non-particulated) protein (FIG. 2A). Protein yield after lectin and strep-tag purification was ~1 mg/L, with ~⅓ of that amount obtained for fractions 16-26 belonging to the first SEC peak. To determine particle formation for the dual-HIV iFerr, negative-stain EM was carried out for several pooled fractions of the dual-HIV iFerr SEC profile: three fraction groups were taken from the first peak (fractions 16-22; 23-25; and 26) and one from the second peak (fraction 33). Particles were observed in all three fraction sets from the first SEC peak, with nanoparticle amount decreasing with latter fractions, while virtually no particles were observed for fraction 33 from the second SEC peak (FIG. 2A).

Figure 4A:
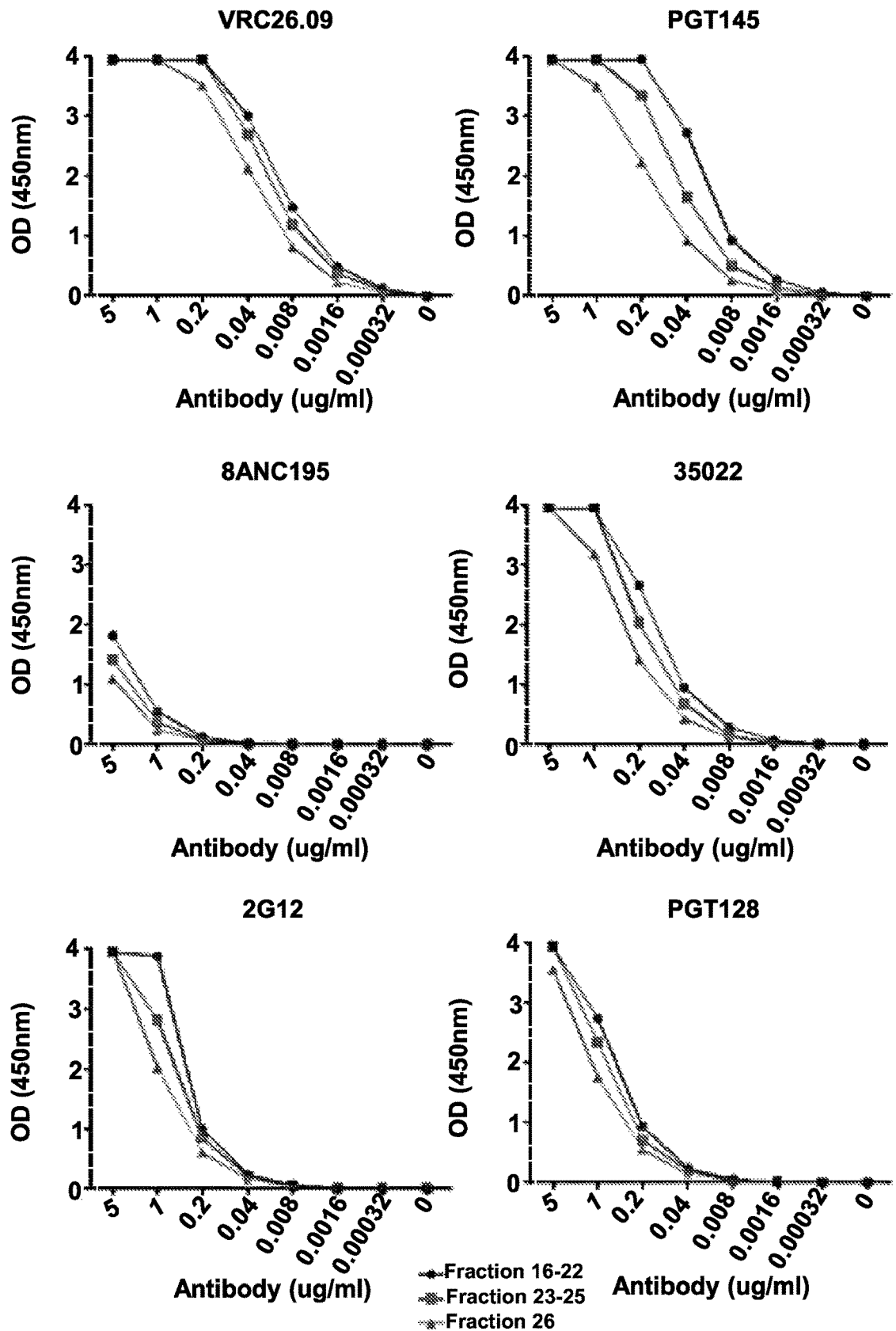
FIGS. 4A and 4B show a set of graphs of results of antigenic characterization of recombinant insect ferritin nanoparticles including HIV-1 Env ectodomain trimers from strain CNE58 on iFerr HC and strain ZM106.9 on iFerr LC by lectin capture ELISA following size-exclusion chromatography. Specific fractions were assessed against a panel of both broadly neutralizing and ineffective HIV-1 specific antibodies. Broadly neutralizing antibodies included the quaternary-specific antibodies VRC26.09 and PGT145 which bind to a membrane distal trimeric V1-V2 epitope, CD4 binding-site antibodies VRC01, 8ANC195, and B12, and gp41-gp120 antibodies PGT151 and 35O22 and the glycan reactive antibodies PGT128 and 2G12. The ineffective HIV-1 antibodies include those that require structural rearrangement of the native HIV-1 Env to allow binding including F105 which binds proximal to the CD4 binding-site, 447-52D which binds to the V3 loop and 17b which can bind following CD4 receptor engagement.
Figure 4B:
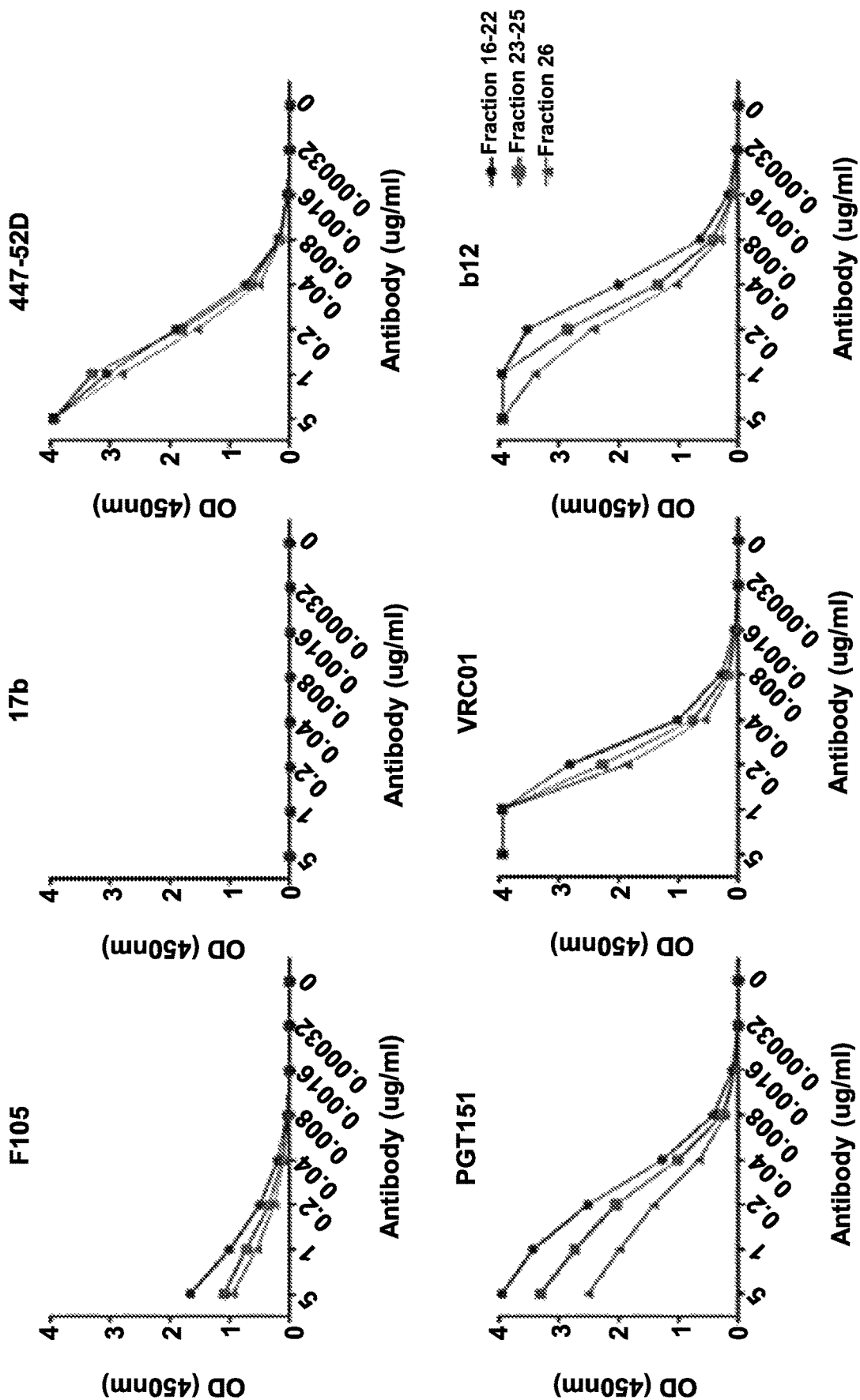

To assess the formation of the trimeric form of the HIV-1 gp140 antigens, the antigenicity profiles for the three fraction sets from the first SEC peak of the dual-HIV iFerr were analyzed using antibody binding by lectin-based ELISA. It was found that the three sets exhibited similar antibody binding profiles (FIG. 2A and FIG. 4). Importantly, strong binding was observed for the quaternary-specific antibodies VRC26 and PGT145 (Doria-Rose et al., Nature 509, 55-62, 2014; McLellan et al., Nature 480, 336-343, 2011), indicating the formation of the closed conformation of the HIV-1 gp140 trimer (Julien et al., Science, 342, 1477-1483, 2013). Low or no binding was observed for ineffective HIV-1 antibodies F105 and 17b, whereas higher levels of binding were observed for antibody 447-52D, similar to what is seen for non-multimerized soluble gp140 before negative selection against species binding to 447-52D (Gorny et al., J. Vivol., 66, 7538-7542, 1992) and other ineffective antibodies targeting the V3 variable region of Env (Do Kwon et al., Nat. struct. Mol. Biol. 22, 522-531, 2015). Binding was observed for a number of other antibodies targeting various sites on Env, including the CD4 receptor binding site (antibodies VRC01 (Wu et al., Science 329, 856-861, 2010) and b12 (Oben et al., J. Vivol., 68, 4821-4828, 1994), V3-glycan site (PGT128 (Walker et al., Nature, 477, 466-470, 2011) and gp120-gp41 composite epitope sites (35022 (Huang et al., Nature, 515, 138-142, 2014) and PGT151 (Blattner et al., Immunity, 40, 669-680, 2014). Taken together, the antigenicity results indicate that HIV-1 Env trimers in a proper conformation can be successfully displayed on iFerr particles.

Figure 5A:
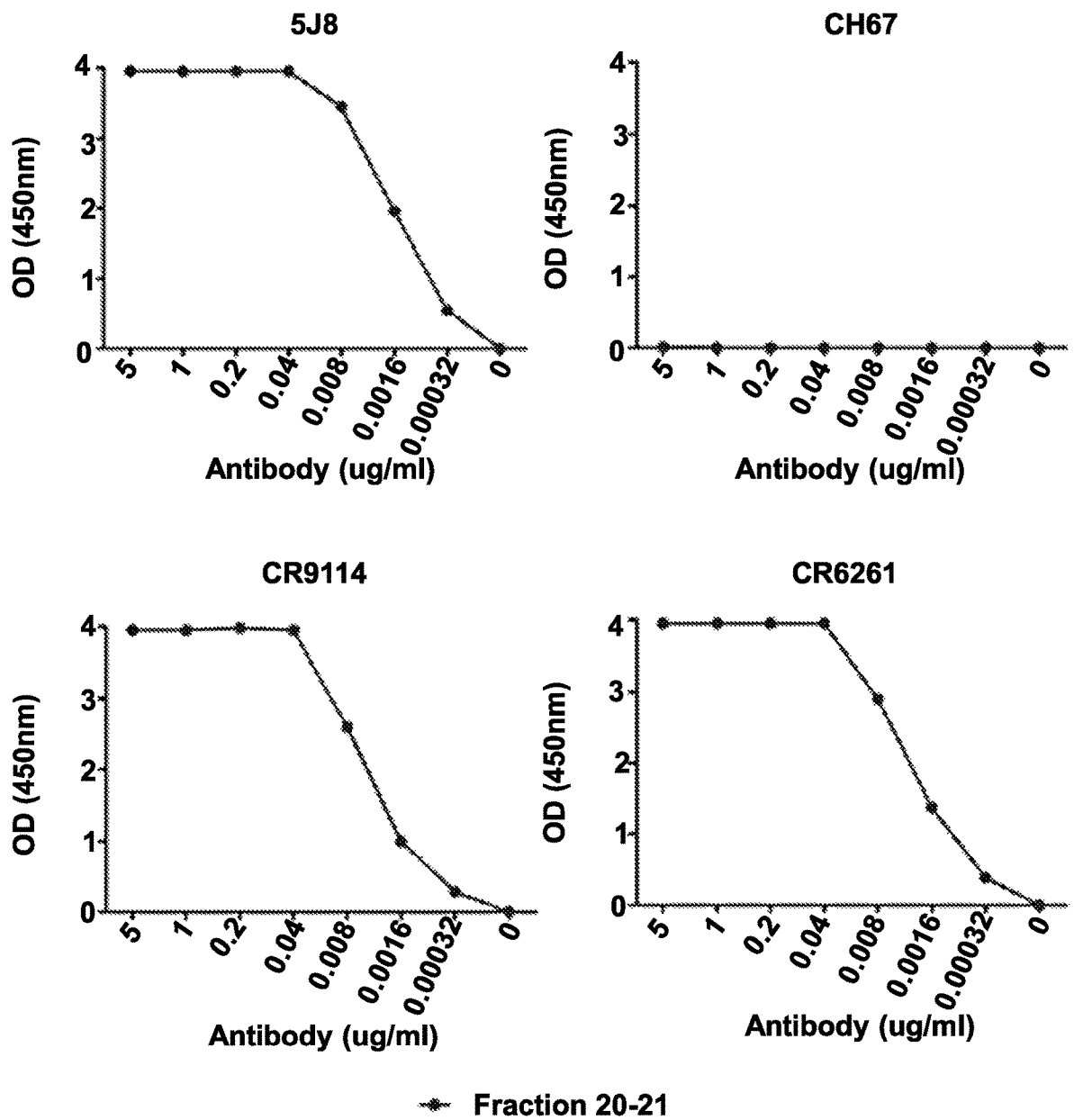
Figure 6A:
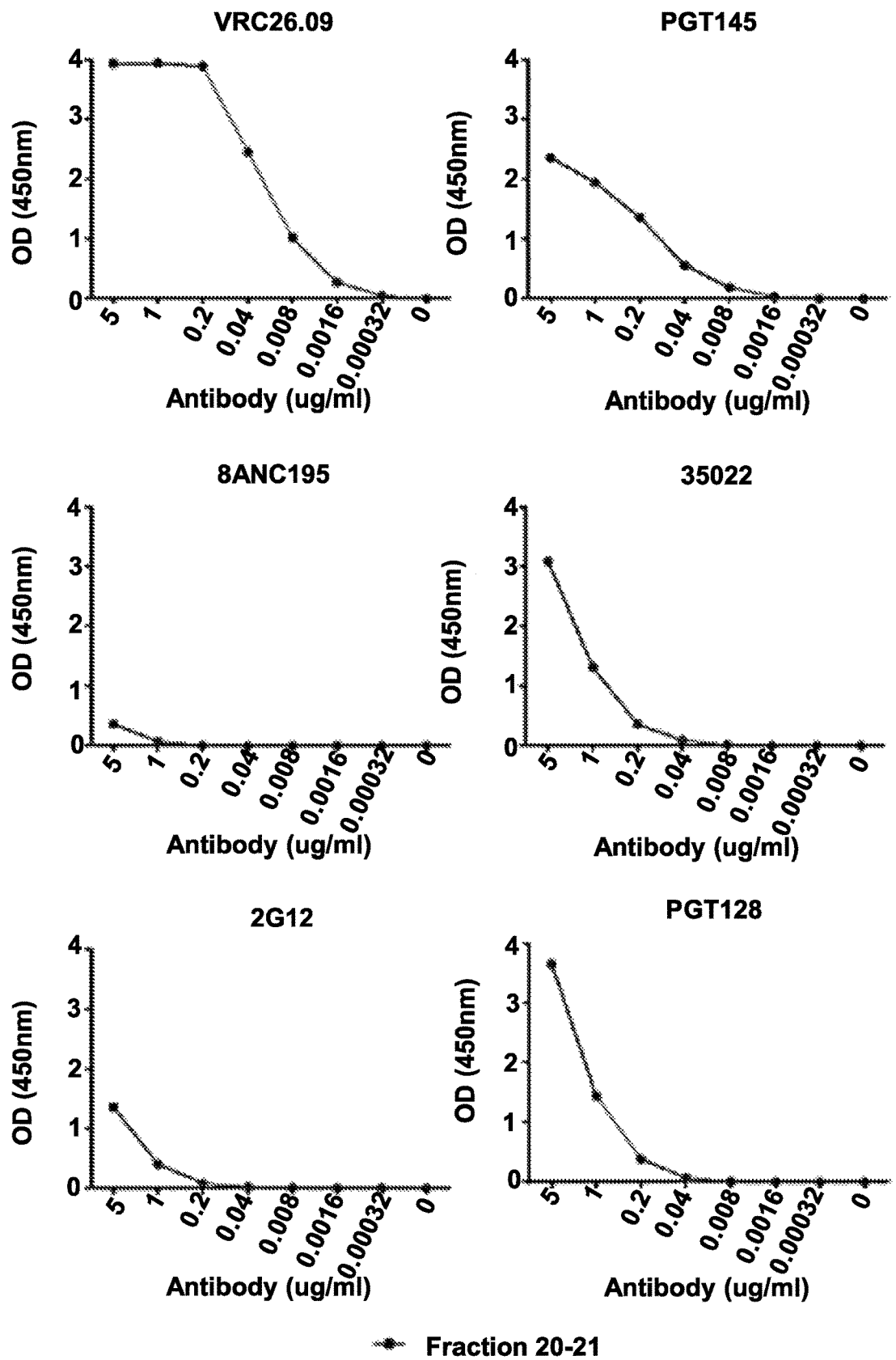
FIGS. 6A-6D show a set of graphs of results of antigenicity characterization of the recombinant insect ferritin nanoparticles including influenza HA ectodomain trimers on iFerr HC and HIV-1 Env ectodomain trimers on iFerr LC by lectin-capture ELISA following size-exclusion chromatography. The nanoparticle was assessed using the same sets of (FIG. 6A) HIV-1 and (FIG. 6B) influenza antibodies as with the dual-HIV and dual-flu constructs.
Figure 6B:
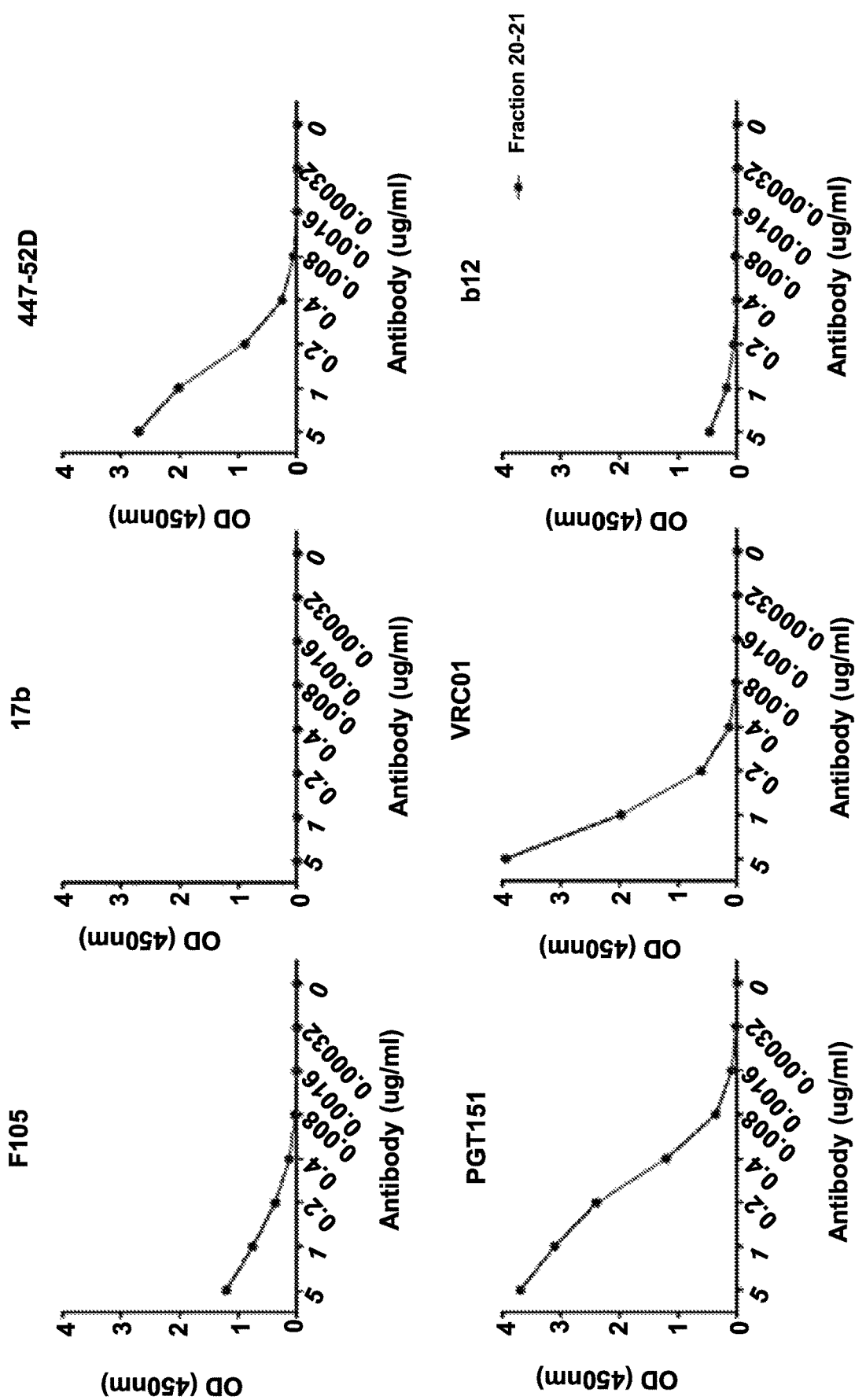
Figure 6C:
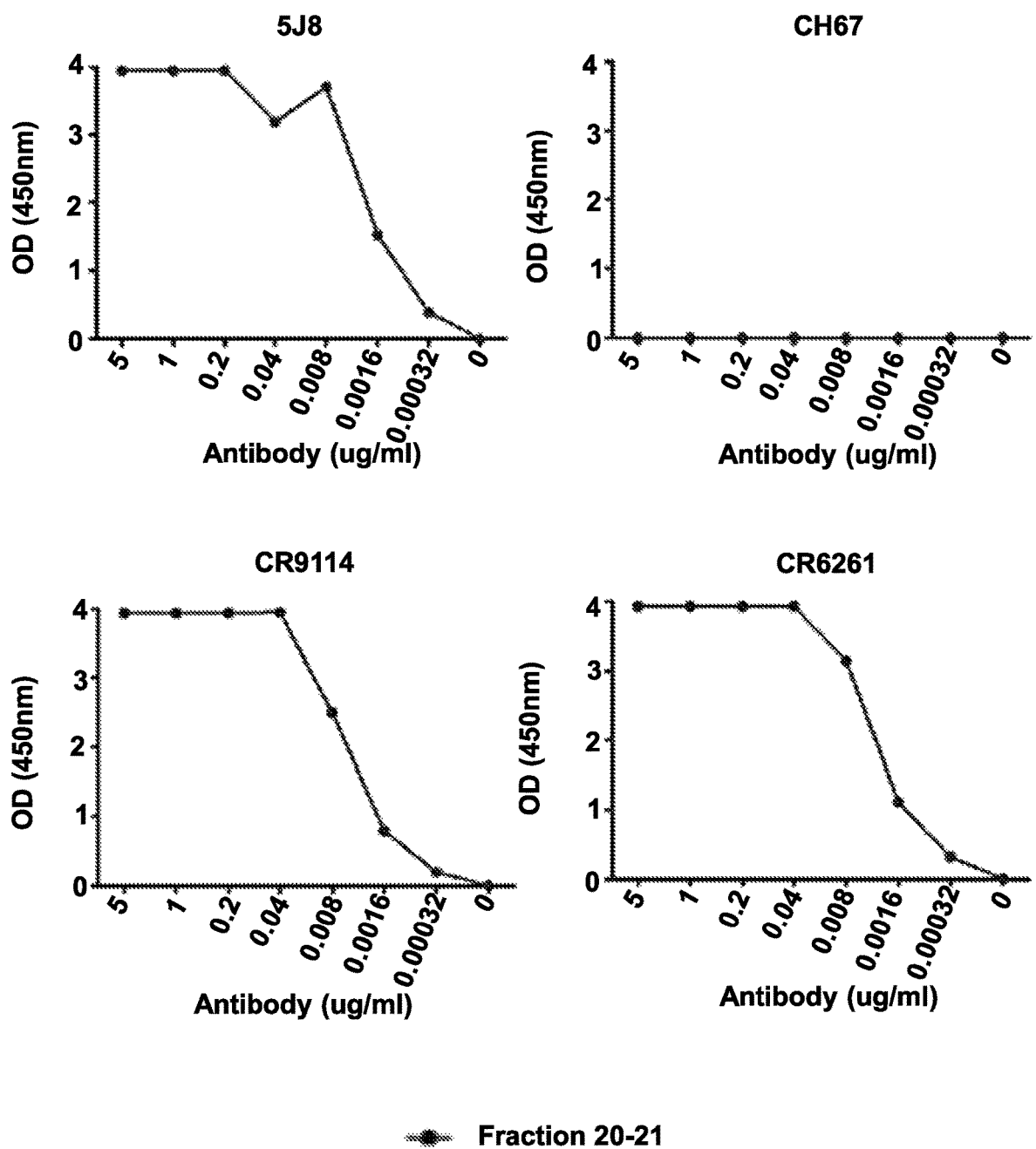
Figure 6D:
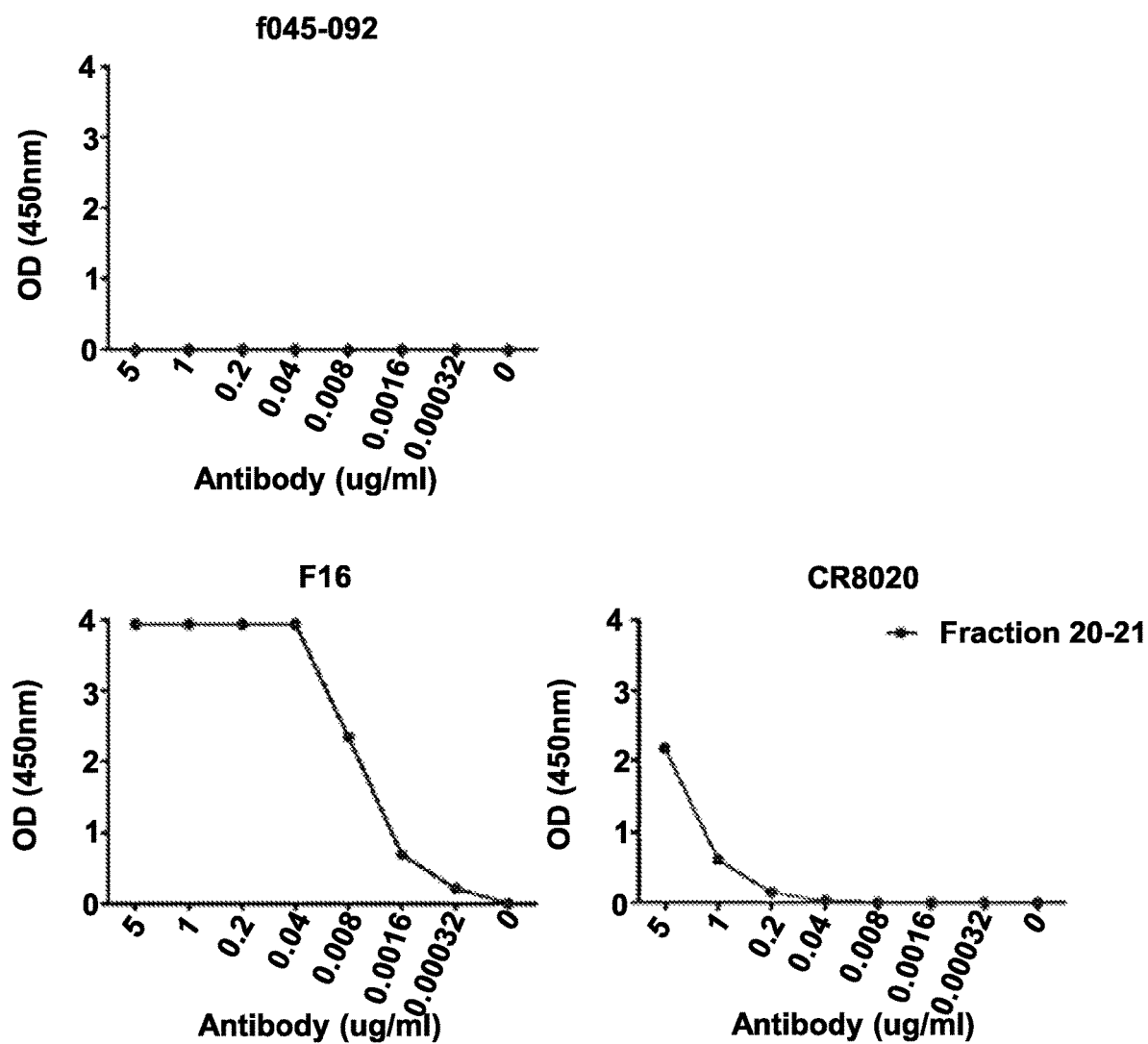

To demonstrate the generality of the iFerr technology, particles with two diverse influenza strain HAs (dual-flu iFerr), as well as particles that incorporated both an influenza HA antigen and an HIV Env antigen (flu/HIV iFerr) (FIGS. 2B and 2C) were tested. The dual-flu iFerr particle incorporated two HAs from viral strains that are part of the current 2015-2016 trivalent or quadrivalent vaccine recommendations: an A/California/7/2009 (H1N1) strain on iFerr HC (SEQ ID NO: 131) and a B/Phuket/3073/2013 (B/Yamagata lineage) strain on iFerr LC (SEQ ID NO: 139). Negative-stain EM confirmed the formation of the dual-HA particles (FIG. 2B). The dual-flu construct bound 5J8, an H1N1-neutralizing antibody that targets the HA head region, and three of the four tested stem antibodies (FIG. 2B and FIG. 5), in agreement with the expected reactivity of the tested antibodies (Lee et al., Nat. Comm., 5, 3614, 2014). The combined influenza/HIV particle incorporated the A/California/7/2009 (H1N1) influenza HA on iFerr HC (SEQ ID NO: 131) and the CNE58 Env on iFerr LC (a fusion of CNE8 (SEQ ID NO: 20) ectodomain and SEQ ID NO: 2 via the five amino acid peptide linker, residues 651-655 of SEQ ID NO: 26). Although sample purity appeared to be lower than the dual-HIV and dual-flu cases, negative-stain EM confirmed the formation of combined influenza/HIV iFerr particles (FIG. 2C). The combined influenza/HIV construct showed binding to both influenza and HIV-1 antibodies (FIG. 2C and FIG. 6). The antigenicity profiles were similar to those observed with the dual-HIV and dual-influenza particles, with the exception of the observed lack of binding to HIV-1 antibodies 8ANC195 and b12, both of which do not neutralize the wildtype CNE58 virus (Chuang et al., J. Vivol., 87, 10047-10058, 2013). Taken together, these results underscore the ability of iFerr particles to display HIV-1 and influenza antigens.

To show that the iFerr constructs are immunogenic, the neutralization properties of sera from guinea pigs inoculated with exemplary iFerr nanoparticles was assayed. Guinea pigs were inoculated with 2-component ferritin nanoparticles containing:
  (1) a heavy chain linked to an HA ectodomain from influenza A CALI (SEQ ID NO: 131), and a light chain linked to an HA ectodomain from influenza B Phuket (SEQ ID NO: 139);
  (2) a heavy chain linked to an HA ectodomain from influenza A CALI (SEQ ID NO: 131), and a light chain linked to an Env ectodomain from HIV-1 CNE58 (a fusion of CNE8 (SEQ ID NO: 20) ectodomain and SEQ ID NO: 2 via the five amino acid peptide linker, residues 651-655 of SEQ ID NO: 26); or
  (3) a heavy chain linked to an Env ectodomain from HIV-1 ZM106, and a light chain linked to an Env ectodomain from HIV-1 CNE58 (a fusion of CNE8

(SEQ ID NO: 20) ectodomain and SEQ ID NO: 2 via the five amino acid peptide linker, residues 651-655 of SEQ ID NO: 26).

Figure 8:
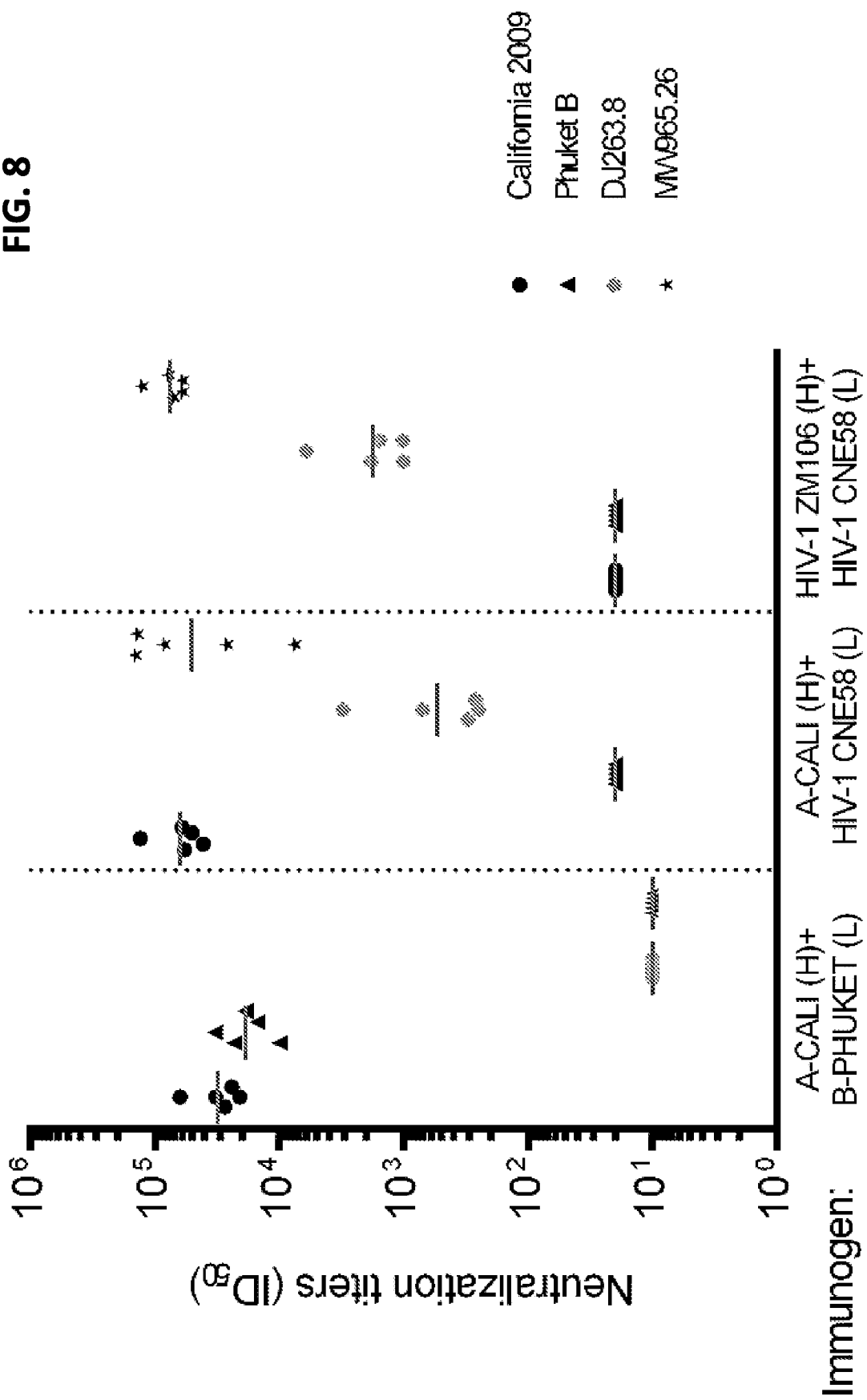
FIG. 8 is a graph showing neutralization titers of guinea pig sera against influenza A (California 2009 strain), influenza B (Phuket B strain), and HIV (DJ263.8 and MW965.26 strains) pseudoviruses. The sera was isolated from guinea pigs inoculated with 2-component ferritin nanoparticles containing (1) a heavy chain linked to an HA ectodomain from influenza A California-2009, and a light chain linked to an HA ectodomain from influenza B Phuket, (2) a heavy chain linked to an HA ectodomain from influenza A California 2009, and a light chain linked to an Env ectodomain from HIV-1 CNE58, or (3) a heavy chain linked to an Env ectodomain from HIV-1 ZM106.9, and a light chain linked to an Env ectodomain from HIV-1 CNE58.
Figure 9:
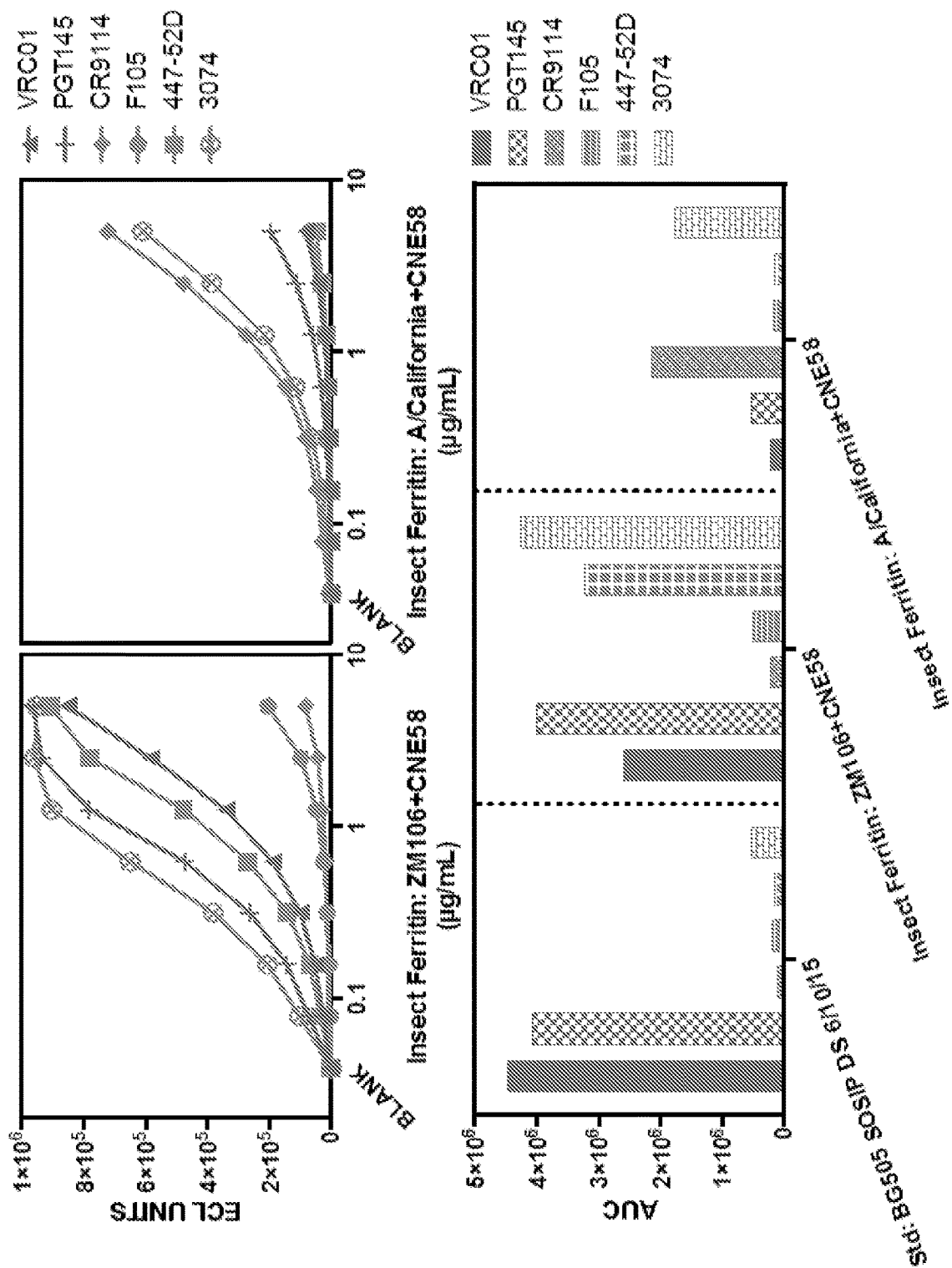
FIG. 9 shows the antigenicity of 2-component ferritin nanoparticles containing a heavy chain linked to an Env ectodomain from HIV-1 ZM106, and a light chain linked to an Env ectodomain from HIV-1 CNE58 or a heavy chain linked to an HA ectodomain from influenza A California 2009 and a light chain linked to an Env ectodomain from HIV-1 CNE58 against a panel of HIV-1 Env- and Influenza-specific) antibodies.

FIG. 8 shows the neutralization titers of such guinea pig sera against influenza A (California 2009 strain), influenza B (Phuket B strain), and HIV (DJ263.8 and MW965.26 strains) pseudoviruses. FIG. 9 shows the antigenicity of 2-component ferritin nanoparticles (2) and (3) listed above for a panel of HIV-1 Env antibodies.

In an additional assay, neutralization properties of sera from guinea pigs inoculated with 2-component ferritin nanoparticles containing:

(4) a heavy chain linked to an Env ectodomain from HIV-1 ZM106 containing the SOSIP and DS substitutions (SEQ ID NO: 31), and a light chain linked to a Chimeric CNE58 Env ectodomain containing the DS substitutions (SEQ ID NO: 26);

(5) a heavy chain linked to an HA ectodomain from influenza A CALI (SEQ ID NO: 131), and a light chain linked to an HA ectodomain from influenza B Phuket (SEQ ID NO: 139); or (6) a heavy chain linked to an HA ectodomain from influenza A CALI (SEQ ID NO: 131), and a light chain linked to a Chimeric CNE58 Env ectodomain containing the DS substitutions (SEQ ID NO: 26).

The following tables show the corresponding neutralizing response (ID50) for 2-comonent ferritin nanoparticles (4), (5), and (6) from sera collected a 6 and 18 weeks post immunization for a variety of HIV-1 strains:

| ID50 | | | | Virus: Clade A | | Clade AC | |
|---|---|---|---|---|---|---|---|
| | | | | BG505.W6M.C2.T332N.SG3 | | 3301.V1.C24.SG3 | |
| Group | Immunogen | Animal ID | Week | wk 6 | wk 18 | wk 6 | wk 18 |
| CGP513 | ZM106 SOSIP | 513-1 | 048-865-836 | <10 | <10 | <10 | <10 |
| | DS(H) + CNE58 | 513-2 | 048-617-882 | <10 | <10 | <10 | <10 |
| | Chimera | 513-3 | 048-621-568 | <10 | <10 | <10 | <10 |
| | DS(L) | 513-4 | 048-619-870 | <10 | <10 | <10 | <10 |
| | Adjuplex | 513-5 | 048-571-294 | <10 | <10 | <10 | <10 |
| CGP514 | A-CALI | 514-1 | 048-572-071 | <10 | <10 | <10 | <10 |
| | (H) + B- | 514-2 | 046-576-854 | <10 | <10 | <10 | <10 |
| | PHUKET (L) | 514-3 | 046-571-278 | <10 | <10 | <10 | <10 |
| | Adjuplex | 514-4 | 046-588-286 | <10 | <10 | <10 | <10 |
| | | 514-5 | 046-589-826 | <10 | <10 | <10 | 20 |
| CGP515 | A-CALI | 515-1 | 048-618-042 | <10 | <10 | <10 | <10 |
| | (H) + CNE58 | 515-2 | 046-570-818 | <10 | <10 | <10 | <10 |
| | Chimera | 515-3 | 048-590-857 | <10 | <10 | <10 | <10 |
| | DS(L) | 515-4 | 048-622-846 | <10 | <10 | <10 | <10 |
| | Adjuplex | 515-5 | 048-835-818 | <10 | <10 | <10 | <10 |
| | ctrl mAb* VRC01 | | | 0.097 | 0.068 | 0.305 | 0.358 |

| ID50 | | | | Virus: Clade AG | | | | Clade B | |
|---|---|---|---|---|---|---|---|---|---|
| | | | | 242-14.SG3 | | DJ263.8.SG3 | | HxB2.DG.SG3 | |
| Group | Immunogen | Animal ID | Week | wk 6 | wk 18 | wk 6 | wk 18 | wk 6 | wk 18 |
| CGP513 | ZM106 SOSIP | 513-1 | 048-865-836 | <10 | <10 | 384 | 1,015 | <10 | 74 |
| | DS(H) + CNE58 | 513-2 | 048-617-882 | <10 | 39 | 1,374 | 1,844 | <10 | <10 |
| | Chimera | 513-3 | 048-621-568 | <10 | 39 | 468 | 6,097 | <10 | 12 |
| | DS(L) | 513-4 | 048-619-870 | <10 | 16 | 1,021 | 1,578 | <10 | 180 |
| | | 513-5 | 048-571-294 | <10 | <10 | 476 | 1,024 | <10 | 93 |
| CGP514 | A-CALI | 514-1 | 048-572-071 | <10 | <10 | <10 | <10 | <10 | <10 |
| | (H) + B- | 514-2 | 046-576-854 | <10 | <10 | <10 | <10 | <10 | <10 |
| | PHUKET (L) | 514-3 | 046-571-278 | <10 | <10 | <10 | <10 | <10 | <10 |
| | | 514-4 | 046-588-286 | <10 | <10 | <10 | <10 | <10 | <10 |
| | | 514-5 | 046-589-826 | <10 | <10 | <10 | <10 | <10 | <10 |
| CGP515 | A-CALI | 515-1 | 048-618-042 | <10 | <10 | 208 | 3,094 | <10 | <10 |
| | (H) + CNE58 | 515-2 | 046-570-818 | <10 | <10 | <10 | 308 | <10 | 15 |
| | Chimera | 515-3 | 048-590-857 | <10 | <10 | <10 | 253 | <10 | <10 |
| | DS(L) | 515-4 | 048-622-846 | <10 | <10 | 1,494 | 709 | <10 | <10 |
| | | 515-5 | 048-835-818 | <10 | <10 | 533 | 268 | <10 | <10 |
| | ctrl mAb* VRC01 | | | >50 | >50 | 0.095 | 0.127 | 0.070 | <0.05 |

| | | | | Clade C Virus | | | | | | | | |
|---|---|---|---|---|---|---|---|---|---|---|---|---|
| | | ID50 | | 001428-2.42.SG3 | | 25925-2.22.SG3 | | CNE58.SG3 | | MW965.26.SG3 | | ZM106.9.SG3 | |
| Group | Immunogen | Animal ID | Week | wk 6 | wk 18 | wk 6 | wk 18 | wk 6 | wk 18 | wk 6 | wk 18 | wk 6 | wk 18 |
| CGP513 | ZM106 SOSIP DS(H) + CNE58 Chimera DS(L) | 513-1 | 048-865-836 | <10 | <10 | <10 | <10 | <10 | 45 | 29,825 | 59,915 | <10 | <10 |
| | | 513-2 | 048-617-882 | <10 | <10 | <10 | <10 | <10 | <10 | 61,281 | 71,469 | <10 | <10 |
| | | 513-3 | 048-621-568 | <10 | <10 | <10 | <10 | <10 | <10 | 33,249 | 127,189 | <10 | <10 |
| | | 513-4 | 048-619-870 | <10 | <10 | <10 | <10 | 35 | 40 | 15,010 | 59,848 | <10 | <10 |
| | | 513-5 | 048-571-294 | <10 | <10 | <10 | <10 | <10 | <10 | 29,381 | 78,424 | <10 | <10 |
| CGP514 | A-CALI (H) + B-PHUKET (L) | 514-1 | 048-572-071 | <10 | <10 | <10 | <10 | <10 | <10 | <10 | <10 | <10 | <10 |
| | | 514-2 | 046-576-854 | <10 | <10 | <10 | <10 | <10 | <10 | <10 | <10 | <10 | <10 |
| | | 514-3 | 046-571-278 | <10 | <10 | <10 | <10 | <10 | <10 | <10 | <10 | <10 | <10 |
| | | 514-4 | 046-588-286 | <10 | <10 | <10 | <10 | <10 | <10 | <10 | <10 | <10 | <10 |
| | | 514-5 | 046-589-826 | <10 | 12 | <10 | 16 | <10 | <10 | <10 | <10 | <10 | <10 |
| CGP515 | A-CALI (H) + CNE58 Chimera DS(L) | 515-1 | 048-618-042 | <10 | <10 | <10 | <10 | <10 | <10 | 4,828 | 85,112 | <10 | <10 |
| | | 515-2 | 046-570-818 | <10 | <10 | <10 | <10 | <10 | <10 | 2,202 | 7,521 | <10 | <10 |
| | | 515-3 | 048-590-857 | <10 | <10 | <10 | <10 | <10 | <10 | 19,642 | 139,421 | <10 | <10 |
| | | 515-4 | 048-622-846 | <10 | 11 | <10 | <10 | <10 | <10 | 17,173 | 144,340 | <10 | <10 |
| | | 515-5 | 048-835-818 | <10 | <10 | <10 | <10 | <10 | <10 | 6,244 | 26,498 | <10 | <10 |
| | ctrl mAb* VRC01 | | | <0.05 | <0.05 | 2.910 | 1.070 | 0.398 | 0.435 | 0.025 | 0.041 | 0.472 | 0.486 |

Figure 10:
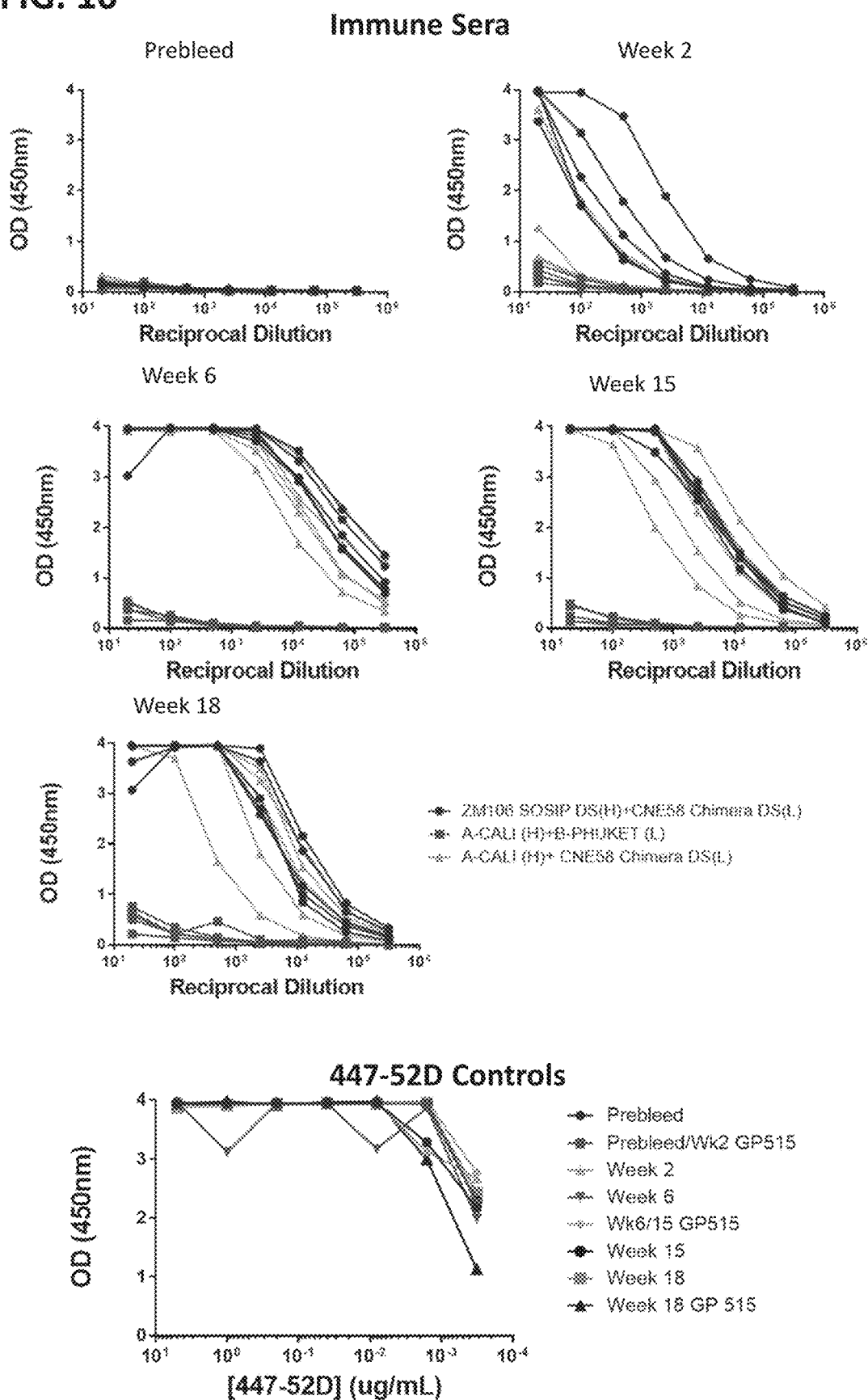
FIG. 10 is a set of graphs showing data from ELISA assays of sera collected from Guinea pigs immunized with 2-component ferritin nanoparticles containing one of combinations (4)-(6): (4) a heavy chain linked to an HIV-1 ZM106 Env ectodomain containing the SOSIP and DS substitutions, and a light chain linked to a chimeric HIV-1 CNE58 Env ectodomain containing the DS substitutions; (5) a heavy chain linked to an HA ectodomain from influenza A CALI, and a light chain linked to an HA ectodomain from influenza B Phuket; or (6) a heavy chain linked to an HA ectodomain from influenza A CALI, and a light chain linked to a chimeric HIV-1 CNE58 Env ectodomain containing the DS substitutions. Guinea pigs immunized with (4) or (6) returned high peak OD values against BG505 V3 Peptide ELISA, confirming immunogenicity of these proteins. A control assay using this V3 peptide and mAb 447-52D showed strong binding as a reference.

To characterize the reactivity of sera collected from the animals immunized with nanoparticles (4), (5), or (6) listed above, sera was tested for binding to a BG505 V3 peptide by ELISA (FIG. 10). The data shows that guinea pigs immunized with ZM106 SOSIP DS+CNE58 Chimera DS (4) or A-CALI+CNE58 Chimera DS (6) return high peak OD values against BG505 V3 Peptide at 6+ weeks by ELISA, confirming immunogenicity of these proteins. A control assay using mAb 447-52D showed weak binding to this antibody.

Figure 11:
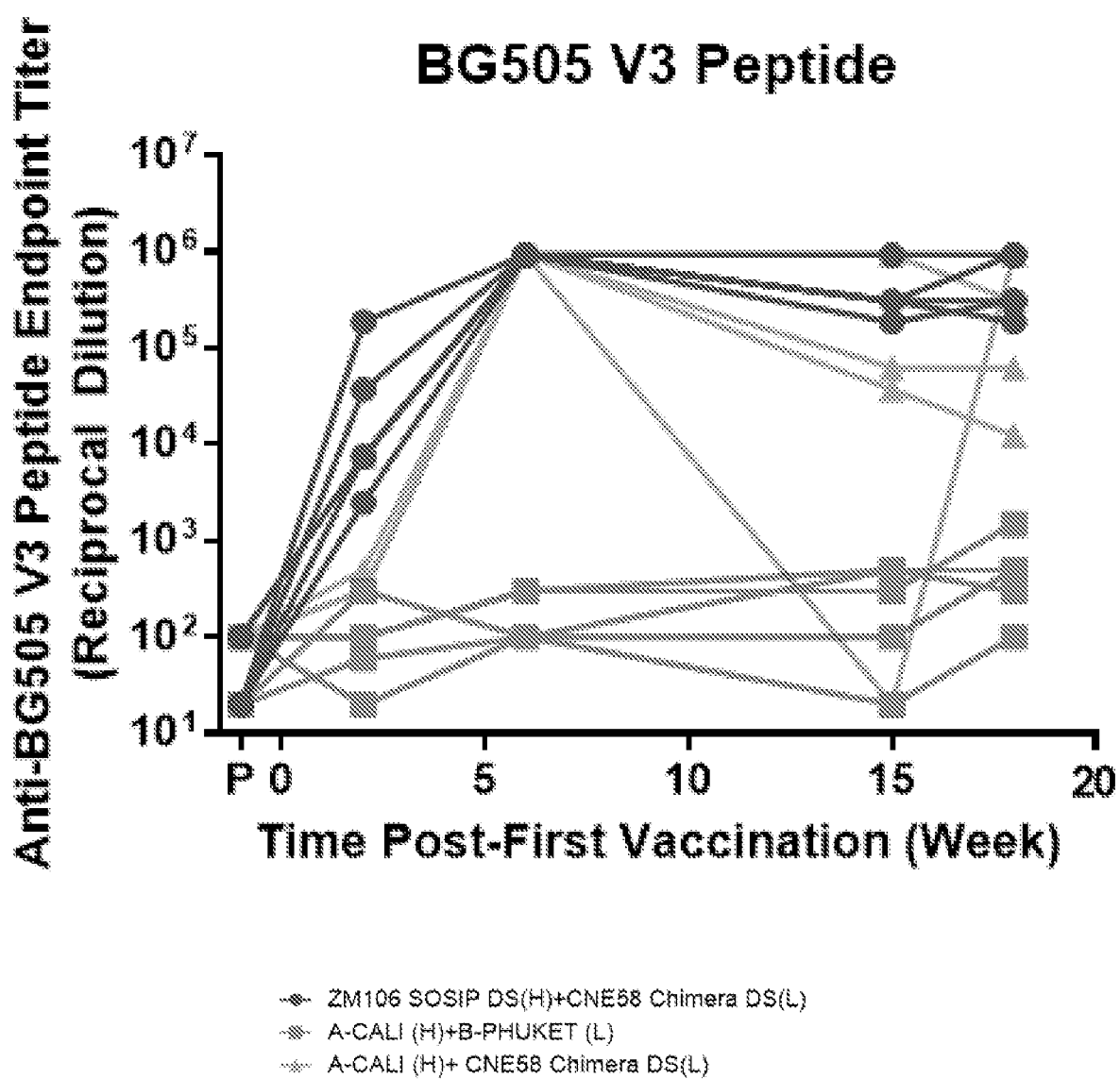
FIG. 11 is a graph showing data from an endpoint titer assay of binding to the BG505 V3 peptide by sera collected from the animals immunized with nanoparticles (4), (5), or (6) listed in FIG. 10. The data shows that guinea pigs immunized with (4) or (6) generate high endpoint titers against BG505 V3 Peptide at 6+ weeks by ELISA.

To further characterize the reactivity of sera collected from the animals immunized with nanoparticles (4), (5), or (6) listed above, sera was tested for binding to the BG505 V3 peptide in an endpoint titer assay (FIG. 11). The data shows that guinea pigs immunized with ZM106 SOSIP DS+CNE58 Chimera DS (4) or A-CALI+CNE58 Chimera DS (6) generate high endpoint titers against BG505 V3 Peptide at 6+ weeks by ELISA.

To further characterize the two-component insect ferritin platform for display of vaccine antigens, recombinant influenza HA stem proteins were linked to the N-terminus of the heavy or light chains (SEQ ID NO: 2 or SEQ ID NO: 6) of the insect ferritin proteins and nanoparticles were expressed in cells, purified, and assessed for purity, antigenicity, structure, and immunogenicity (FIGS. 12-15). The following sequences (in various combinations of heavy and light chains) were assayed:

iH: SEQ ID NO: 2 (with a signal peptide for expression purposes)
iL: SEQ ID NO: 6 (with a signal peptide for expression purposes)
H1iL: SEQ ID NO: 167 (with a signal peptide set forth as SEQ ID NO: 184 for expression purposes)
H3iH: SEQ ID NO: 175 (with a signal peptide set forth as SEQ ID NO: 185 for expression purposes)
H7iH (or H7_26 iH): SEQ ID NO: 182 (with a signal peptide set forth as SEQ ID NO: 186 for expression purposes)

Figure 12:
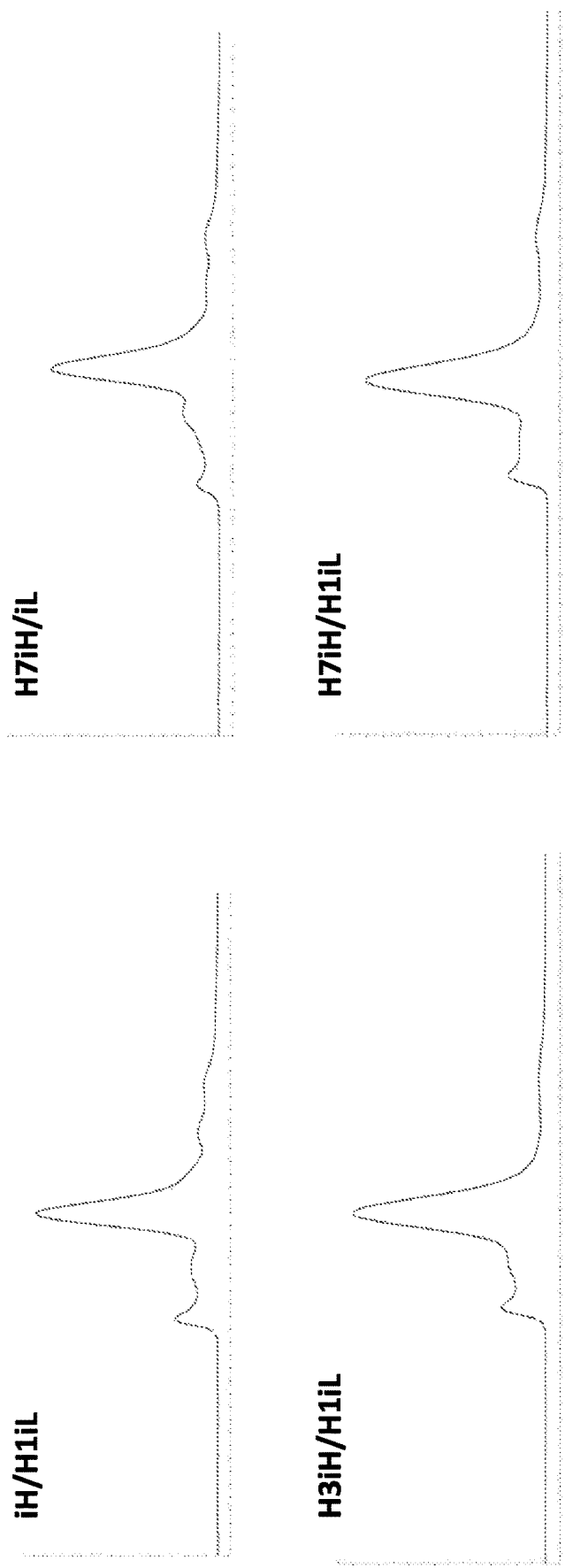
FIG. 12 shows a set of graphs of results for size exclusion gel filtration chromatography of two-component insect ferritin nanoparticles including recombinant influenza HA stem proteins as antigens.
Figure 13:
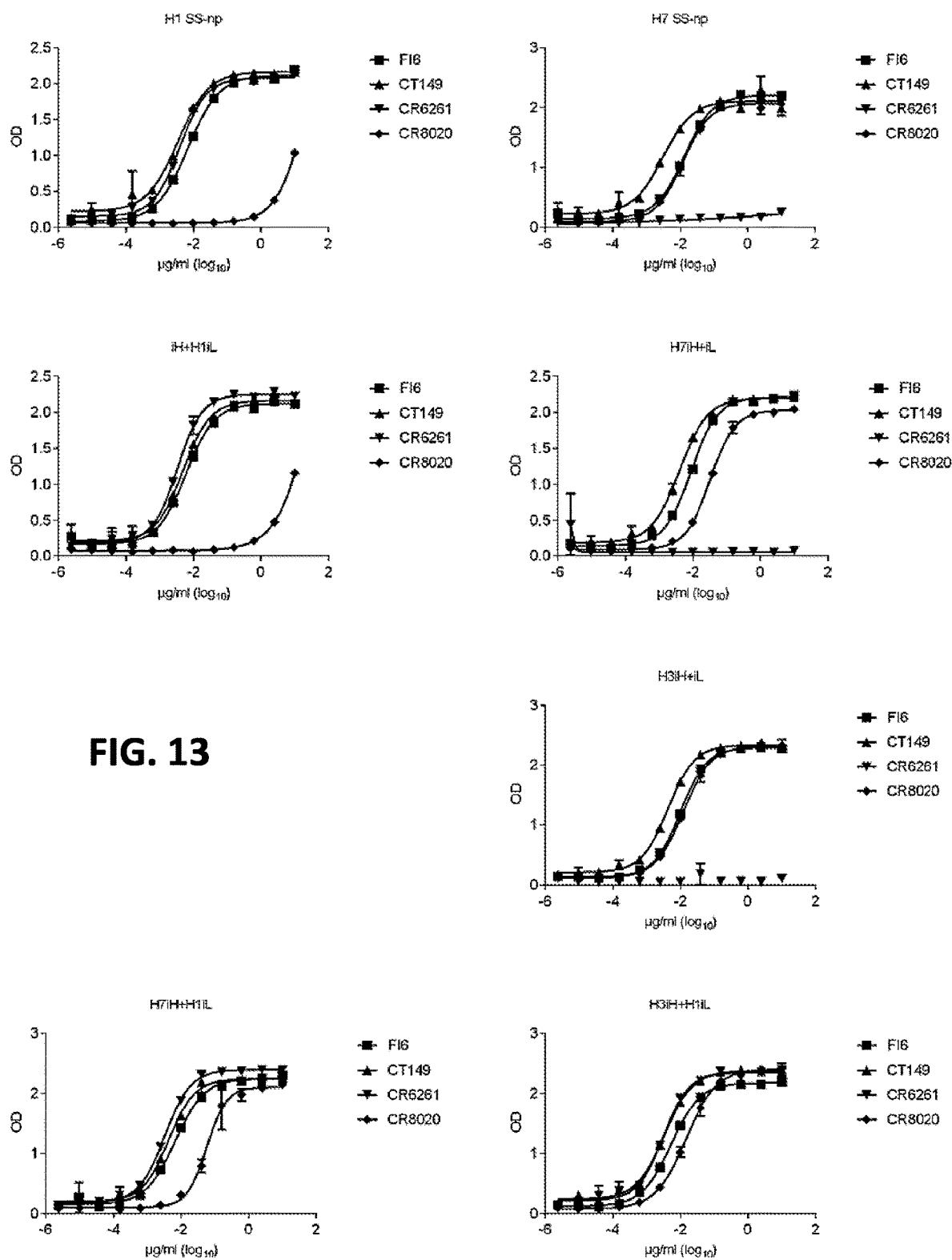
FIG. 13 shows a set of graphs of results for the antigenicity of two-component insect ferritin nanoparticles including recombinant influenza HA stem proteins as antigens.
Figure 14:
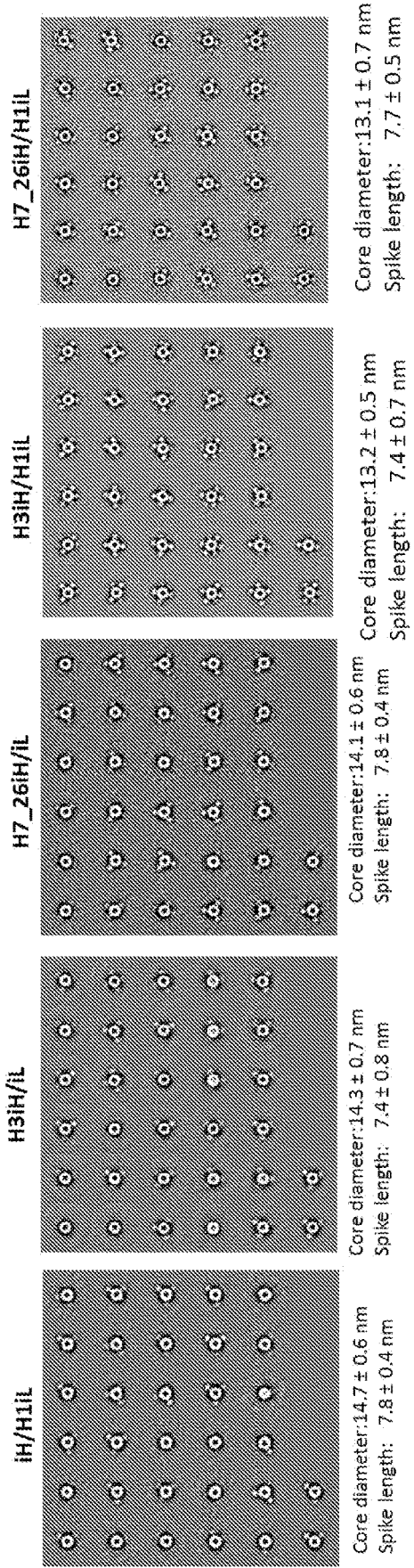
FIG. 14 shows a set of EM images for two-component insect ferritin nanoparticles including recombinant influenza HA stem proteins as antigens.

Initially, the two-component insect ferritin nanoparticles were Lectin affinity purified, and then subjected to superpose size exclusion column (FIG. 12). The elution profiles showed a major single peak for each nanoparticle with little or no aggregation and well-formed particles with no disintegration. Next, the antigenicity of purified nanoparticles was assessed by ELISA for binding to various HA-specific antibodies (FIG. 13). The results showed that the antigenicity of the two-component ferritin nanoparticles matched that of the corresponding influenza HA-stem proteins included on the nanoparticles. Negative stain EM further showed that the nanoparticles were properly formed and contained trimeric antigenic spikes extending radially outward from the ferritin core (FIG. 14). The EM data also highlights different spike densities for either group1 or group2 stem alone, and group 1/group2 presented together.

Additionally, the two component insect ferritin nanoparticles containing influenza HA stem antigens were assessed for immunogenicity in mice. Sera from mice immunized with the nanoparticles was evaluated for binding to HA from various influenza strains by ELISA endpoint titer analysis (FIG. 15). BALB/c mice (n=10) were immunized with 2 doses of the insect ferritin nanoparticles including control (no HA), or either group 1 (H1iL) or group 2 (H3iH or H7iH) HA-stem, or both group 1 and group 2 HA-stem together (H3iH/H1iL or H7iH/H1iL). The nanoparticles including both group 1 and group 2 HA stems on the surface elicited broad immune response against multiple group 1 (H1HA NC99 and H5HA-VN 04) and group 2 (H3HA-HK68 and H7HA-Anhui) antigens.

The iFerr technology presented here can be extended to trimeric or monomeric antigens other than those derived from HIV-1 and influenza. Further, the combined influenza/HIV particles serve as a proof that diverse antigens can be placed on a single particle, in a regular repetitive pattern.

Methods

Design of iFerr Particles for Multimerization of Trimeric Antigens.

The iFerr structure was obtained from PDB ID 1Z6O (Hamburger et al., *J Mol. Biol.,* 349, 558-569, 2005). Using structure-based design, several iFerr HC and iFerr LC variants were selected: 16-residue, 18-residue, and 19-residue N-term deletions for iFerr HC, and 29-residue and 35-residue N-term deletions for iFerr LC. The iFerr HC variants were tested with and without a L113Y mutation; the iFerr LC variants were tested with and without a L123E/I189K double mutation. Expression levels were best for the 18-residue N-term deletion in iFerr HC (SEQ ID NO: 2), effectively placing the new N-term at residue position 19; and the 29-residue N-term deletion for iFerr LC (SEQ ID NO: 6), effectively placing the new N-term at residue position 30.

Antigen constructs. HIV-1: gp140 variants from two diverse clade C strains were used in the analysis: a SOSIP-type molecule based on strain CNE58 (Shang et al., J. Biol. Chem., 286, 14531-14541, 2011) and strain ZM106.9 (Derdeyn et al., *Science,* 303, 2019-2022, 2004). Both gp140 constructs had a disulfide mutation (201C 433C) for stabilizing the closed trimer conformation. Influenza: HA antigens from strains A/California/7/2009(H1N1) and B/Phuket/3073/2013. The C-term of the antigens were linked to the N-term of the respective iFerr sequences using flexible Gly-Ser linker of size 2 or 5 for attachment to iFerr HC and 5 for attachment to iFerr LC. In the case of the HIV-iFerr constructs, a C-terminal Strep-tag was added.

Expression and Purification.

Proteins were purified using snowdrop lectin from Galanthus nivalis (EY Laboratories, San Mateo, Calif.) affinity chromatography at 4° C., and eluted using 1 M methyl-α-d-manno-pyranoside-phosphate-buffered saline (PBS), pH 7.4. After concentration (concentrators of size 10K-150K MWCO were used (Millipore), size-exclusion chromatography was performed using a HiPrep 16/60 Sephacryl S-500 HR column (GE Healthcare Bio-Sciences AB). Fractions of interest were pooled and concentrated. For the dual-HIV iFerr particle, strep-based negative selection was also performed prior to size-exclusion chromatography. In brief, the concentrated lectin chromatography eluent was applied to a Streptactin II affinity column and the flow through and wash fractions were pooled and concentrated prior to size-exclusion chromatography, with the C-terminal Strep-tag allowing removal of mis-folded molecules.

Antigenic Characterization.

96-well MaxiSorp plates (Thermo Fisher Scientific) were coated overnight at 4° C. with 100 μl/well of snowdrop lectin from Galanthus nivalis (Sigma Aldrich) at 2 μg/ml, diluted in 1×PBS. The plates were then blocked at room temperature for 1 hr using 200 μl/well of 5% skim milk, 1.5% bovine serum albumin (BSA) in 0.05% Tween-20+1×PBS, followed by washing (wash buffer: 0.05% Tween-20+1×PBS). iFerr nanoparticles at 2 μg/ml, diluted in 10% fetal bovine serum (FBS) 1×PBS were added to the plates and incubated for two hours followed by washing. Antibodies were 5-fold serially diluted in 0.2% Tween-20+1×PBS starting at 5 m/ml and transferred to the plate and incubated for 1 hr followed by washing. Plates were then incubated for one hour with horseradish peroxidase (HRP)-conjugated anti-human IgG (1:5000) diluted in 0.2% Tween-20+1×PBS, washed and incubated with SureBlue TMB Peroxidase Substrate (KPL) for 10 minutes. The reaction was stopped with 1 N $H_2SO_4$ and then the absorbance was measured at 450 nm. All incubations were at 100 μl/well at room temperature, except where noted otherwise.

Negative-Stain Electron Microscopy.

Samples were diluted to ~0.03 mg/ml, adsorbed to a freshly glow-discharged carbon-film grid for 15 s, and stained with 0.7% uranyl formate. Images were collected semi-automatically using SerialEM on a FEI Tecnai T20 with a 2 k×2 k Eagle CCD camera at a pixel size of 0.22 nm/px.

It will be apparent that the precise details of the methods or compositions described may be varied or modified without departing from the spirit of the described embodiments. We claim all such modifications and variations that fall within the scope and spirit of the claims below.

SEQUENCE LISTING (186 sequences)

SEQ ID NO: 1 - protein, 191 aa, Trichoplusia ni
TQCNVNPVQIPKDWITMHRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 2 - protein, 173 aa, Artificial Sequence
  Recombinant ferritin protein
RSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 3 - protein, 211 aa, Manduca sexta
MKAILLSVAGLLAVLAPAIATQCHVNPVNIQREWITMHRSCRDSMRRQIQMEVGASLQYLAMGAHFSKDKINRPGFAKLFFDAAGEEREHAMKLIEYLLMRGELTNDVTSLIQVRAPQRNKWEGGVDALEHALKMESDVTKSIRTVIKACEDDPEFNDYHLVDYLTGEFLEEQYKGQRDLAGKASTLKKMLDRNSALGEFIFDKKLMGMDI

SEQ ID NO: 4 - protein, 173 aa, Artificial Sequence
  Recombinant ferritin protein
RSCRDSMRRQIQMEVGASLQYLAMGAHFSKDKINRPGFAKLFFDAAGEEREHAMKLIEYLLMRGELTNDVTSLIQVRAPQRNKWEGGVDALEHALKMESDVTKSIRTVIKACEDDPEFNDYHLVDYLTGEFLEEQYKGQRDLAGKASTLKKMLDRNSALGEFIFDKKLMGMDI

SEQ ID NO: 5 - protein, 200 aa, Trichoplusia ni
GITSNSLALPRCNAVYGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 6 - protein, 183 aa, Artificial Sequence
  Recombinant ferritin protein
EYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 7 - protein, 232 aa, Manduca sexta
MNPITFFVACLLALCGAVAADTCYQDVSLDCSQVSNSLTLPNCNAVYAEYGHHGNVAKEMQAYAALHLERSYEYLLSSSYFNNYQTNRAGFSKLFRKLSDDAWEKTIDLIKHITMRGDEMNFAQRSTQKSVDRKNYTVELHELESLAKALDTQKELAERAFFIHREATRNSQHLHDPEVAQYLEEEFIEDHAKTIRNLAGHTTDLKRFVSGDNGQDLSLALYVFDEYLQKTV

SEQ ID NO: 8 - protein, 184 aa, Artificial Sequence
  Recombinant ferritin protein
EYGHHGNVAKEMQAYAALHLERSYEYLLSSSYFNNYQTNRAGFSKLFRKLSDDAWEKTIDLIKHITMRGDEMNFAQRSTQKSVDRKNYTVELHELESLAKALDTQKELAERAFFIHREATRNSQHLHDPEVAQYLEEEFIEDHAKTIRNLAGHTTDLKRFVSGDNGQDLSLALYVFDEYLQKTV

SEQ ID NO: 9 - protein, 856 aa, Human immunodeficiency virus
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 10 - protein, 860 aa, Human immunodeficiency virus
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 11 - protein, 852 aa, Human immunodeficiency virus
MTVTGTWRNYQQWWIWGILGFWMLMICNGLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVITQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRAMYASPIAGEITCKSNITGLLLTRDGGGNNSTEETFRPGGGNMRDNWRSELYKYKVVEVKPLGIAPTEARRRVVQKEKRAVVGLGAVFLGFLGTAGSTMGAASITLTVQARQLLSGIVQQQSNLLRAIEAQQHMLQLTVWGIKQLQARVLAIERYLKDQQLLGMWGCSGKLICTTNVYWNSSWSNKTYNEIWDNMTWMQWDREIDNYTDTIYKLLEVSQKQQESNEKDLLALDSWNNLWNWFDISKWLWYIKIFIMIVGGLIGLRIIFAVLSLVNRVRQGYSPLSFQTLTPNPRELDRLGGIEEEGGEQDRDRSIRLVSGFFSLAWNDLRSLCLFCYHRLRDFILIAGRAVELLGRSSLQGLQRGWEILKYLGSLVQYWGLELKKSAINLFDTIAIAVAEGTDRIIEFLQRIVRAILHIPRRIRQGFEAALQ

SEQ ID NO: 12 - protein, 855 aa, Human immunodeficiency virus
MRVMGIQRNCQHLLTWGIMILGTIIFCSAVENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGNIRQAHCNVSRSEWNKTLQQVAKQLGKYFGNKKVIFNSSSGGDLEITTHSFNCGGEFFYCNTSGLFNSTWTWDNSTWNQVNSTESNDTIILQCRIKQIINMWQRTGQAIYAPPIQGEIRCVSNITGLLLTRDGGNNNGTSETFRPEGGNMRDNWRSELYKYKVVEIEPLGVAPTRAKRRVVEREKRAVGIGAVFLGFLGAAGSTMGATSITLTVQARQLLSGIVQQQNNLLRAIEAQQHLLKLTVWGIKQLQARVLAVERYLRDQQLLGIWGCSGKLICTTNVPWNSSWSNKSLDEIWNNMTWLQWDKEINNYTQLIYRLIEESQNQQEKNEKELLELDKWANLWSWFDISNWLWYIKIFIIIVGGLIGLRIVFAVLSVINRVRQGYSPLSFQTHTPNPRGLDRPERIEEEDGEQGRGRSIRLVSGFLALAWDDLRSLCLFSYHRLRDFILIAARTVELLGHSSLKGLRLGWEGIKYLWNLLSYWGRELKISAINLVDTIAIAVAGWTDRVIEIAQRIGRAILHIPVRIRQGLERALL

SEQ ID NO: 13 - protein, 857 aa, Human immunodeficiency virus
MRVMGIQRNCQHLLRRGTMILGMIIICGTAEDLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTKAKRRVVEREKRAVGLGAVFIGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSYNEIWENMTWLQWDKEINNYTELIYSLIEESQNQQEKNEQDLLALDKWASLWNWFDISNWLWYIKIFIMIVGGLIGLRIVVAVLSVINRVRQGYSPLSFQTHTPNPRGLDRPERIEEEGGEQDRTRSTRLVSGFLALAWDDLRSLSLFLYHRLRDFILIAARTVELLGHSSLKGLRLGWEGLKYLWNLLLYWGRELKLSAINLLNTIAIAVAGWTDRVIEIGQGIGRAILHIPRRIRQGFERALL

SEQ ID NO: 14 - protein, 873 aa, Human immunodeficiency virus
MRVTGIRKNCRRLWRWGIMLLGMLMICSALENLWVTVYYGVPVWKDATTTLFCASDAKGYETEVHNVWATHACVPTDPNPQELVLGNVTENFNMWKNDMVDQMHEDVISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSAITQACPKVTFDPIPIHYCAPAGYAILKCNNKTFNGTGPCRNVSTVLCTHGIKPVVSTQLLLNGSLAEEDIIIRSENLTNNAKTIIVHLNESVEIVCTRPGNNTRKGIGIGPGQTFYATGEIIGDIRKAHCNISKDNWTETLYRVSRKLKHFWNKTIIFAPHSGGDLEITTHSFNCRGEFFYCNTSGLFNGTLNDTYMHNSTKSNETITIPCKIRQIVRMWQQVGQAMYAPPIEGNITCKSNITGLLLVRDGGNINRTNETFRPEGGDMRDNWRSELYKYKVVEIKPLGIAPTKAKRRVVEREKRAVGLGAVFLGFLGIAGSTMGAASITLTVQARQLLSGIVQQQNNLLKAIEAQQHLLQLTVWGIKQLQARVLAIERYLKDQQLLGIWGCSGKLICTTAVAWNSSWSNKSLGEIWDNMTWMQWDKEINNYTSIIYSLLEDSQIQQEKNEKDLLALDSWNNLWNWFDITSWLWYIRLFIMIVGGLIGLRIIFAVLSIVNRVRQGYSPLSFQTLTPNPIPGGPDRLGRIEEEGGEQDRDRSIRLVSGFLALAWDDLRNLCLFSYHRLRDFILVTARVVELLGRSSLRGLQRGWEALKYLGSLVQYWGQELKKSAISLIDTIAITVAEGTDRIIEAVQRLCRGIYNIPRRIRQGFEAALQ

SEQ ID NO: 15 - protein, 835 aa, Human immunodeficiency virus
MRVRGIMRNWQQWWIWGSLGFWMLIICNVMGSLWVTVYYGVPVWREAKTTLFCASDAKAYETEAHSVWATHACVPTDPNPQEMVLENVTENFNMWKNDMVDQMHEDVISIWDQSLKPCVKLTPLCVTLDCSTYNNTHNISKEMKICSFNMTTELRDKKRKVNVLFYKLDLVPLTNSSNTTNYRLISCNTSTITQACPKVSFDPIPIHYCAPAGYAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRAMYAPPIAGNITCKSNITGLLLTRDGGENSSSTTETFRPTGGDMKNNWRSELYKYKVVEIKPLGIAPTEAKRRVVEREKRAVGIGAVFLGFLGAAGSTMGAASMTLTVQARQLLSGIVQQQSNLLKAIEAQQHMLQLTVWGIKQLQARVLAIERYLKDQQLLGLWGCSGKLICTTNVPWNASWSNKSKNDIWDNMTWMQWDREISNHTDTIYRLLEDSQNQQEKNEKDLLALDSWKNLWNWFSITKWLWYIKIFIMIVGGLIGLRIIFAVLSIVNRVRQGYSPLSFQTLTPNPRGPDRLGGIEEEGGEQDKNKSRRLVTGFLPVVWDDLRSLCLFSYHLLRDFILIVARTVELLGRRGWEALKYLGGLVQYWGLELKKSTISLLDTIAIVVAEGTDRIIEVLQRIGRAIYNIPRRIRQGFETALL

SEQ ID NO: 16 - protein, 853 aa, Human immunodeficiency virus
MRVMGIQRNCQHLLTWGIMILGTIIFCSAVENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSAITQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNNTRKSIRIGPGQAFYATGDIIGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQAMYAPPIPGVIKCESNITGLLLTRDGGKDNNVNETFRPGGGDMRDNWRSELYKYKVVEIEPLGVAPTRAKRRVVEREKRAVGIGAVFLGFLGAAGSTMGATSITLTVQARQLLSGIVQQQNNLLRAIEAQQHLLKLTVWGIKQLQARVLAVERYLRDQQLLGIWGCSGKLICTTNVPWNSSWSNKSLDEIWNNMTWLQWDKEINNYTQLIYRLIEESQNQQEKNEKELLELDKWANLWSWFDISNWLWYIKIFIIIVGGLIGLRIVFAVLSVINRVRQGYSPLSFQTHTPNPRGLDRPERIEEEDGEQGRGRSIRLVSGFLALAWDDLRSLCLFSYHRLRDFILIAARTVELLGHSSLKGLRLGWEGIKYLWNLLSYWGRELKISAINLVDTIAIAVAGWTDRVIEIAQRIGRAILHIPVRIRQGLERALL

SEQ ID NO: 17 - protein, 864 aa, Human immunodeficiency virus
MRVKETQMNWPNLWKWGTLILGLVIICSASDNLWVTVYYGVPVWRDADTTLFCASDAKAHETEVHNVWATHACVPTDPNPQEIDLENVTENFNMWKNNMVEQMQEDVISLWDQSLKPCVKLTPLCVTLHCTNANLTKANLTNVNNRTNVSNIIGNITDEVRNCSFNMTTELRDKKQKVHALFYKLDIVPIEDNNDNSKYRLINCNTSVIKQACPKISFDPIPIHYCTPAGYAILKCNDKNFNGTGPCKNVSSVQCTHGIKPVVSTQLLLNGSLAEEEIIIRSEDLTNNAKTIIVHLNKSVVINCTRPSNNTRTSITIGPGQVFYRTGDIIGDIRKAYCEINGTEWNKALKQVTEKLKEHFNNKPIIFQPPSGGDLEITMHHFNCRGEFFYCNTTRLFNNTCIANGTIEGCNGNITLPCKIKQIINMWQGAGQAMYAPPISGTINCVSNITGILLTRDGGATNNTNNETFRPGGGNIKDNWRNELYKYKVVQIEPLGAAPTRAKRRVVEREKRAVGIGAMIFGFLGAAGSTMGAASITLTVQARQLLSGIVQQQSNLLRAIEAQQHLLQLTVWGIKQLQARVLAVERYLKDQKFLGLWGCSGKIICTTAVPWNSTWSNKSLEEIWNNMTWIEWEREISNYTNQIYEILTKSQDQQDRNEKDLLELDKWASLWTWFDITNWLWYIKIFIMIVGGLIGLRIIFAVLSIVNRVRQGYSPLSFQTPCHHQREPDRPERIEEEGGEQGRDRSVRLVSGFLALAWDDLRSLCLFSYHRLRDFILIAARTVELLGRSSLKGLRRGWEGLKYLGNLLLYWGQELKISAISLLDATAIAVAGWTDRVIEVAQGAWKAILHIPRRIRQGLERALQ

SEQ ID NO: 18 - protein, 849 aa, Human immunodeficiency virus
MKVMGTKKNYQHLWRWGIMLLGMLMMSSAAEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGGSNSSQNETFRPGGGNMKDNWRSELYKYKVVKIEPLGIAPTRAKRRVVQREKRAVTLGAVFLGFLGAAGSTMGAASLTLTVQARLLLSGIVQQQSNLLRAIEAQQHMLQLTVWGIKQLQARVLAIERYLKDQQLLGIWGCSGKLICTTTVPWNTSWSNKSYDYIWNNMTWMQWEREIDNYTGFIYTLIEESQNQQEKNELELLELDKWASLWNWFNITNWLWYIKLFIMIIGGLVGLRIVCAVLSIVNRVRQGYSPLSFQTRLPNPRGPDRPEETEGEGGERDRDRSARLVNGFLAIIWDDLRSLCLFSYHRLRDLLLIVARVVEILGRRGWEILKYWWNLLKYWSQELKNSAVSLLNVTAIAVAEGTDRVIEIVQRAVRAILHIPTRIRQGFERALL

SEQ ID NO: 19 - protein, 814 aa, Human immunodeficiency virus
VVGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVEREKRAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALDSWNNLWNWFDISNWLWYIKIFIMIVGGLIGLRIIFAVLSIVNRVRQGYSPLSFQTLTQNPRGLDRLGRIEEEGGEQDRDRSVRLVNGFLALFWDDLRSLCLFSYHRLRDFILIATRVVELLGRSSLKGLQRGWEALRYLGSRVQYWGLELKKSAISLFDTIAIAVAEGTDRIIELIQRSWRAIRNIPRRIRQGFETALL

SEQ ID NO: 20 - protein, 848 aa, Human immunodeficiency virus
VGGNMWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVEIKPLGVAPTEAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSHEEIWNNMTWMQWDREISNYTNIIYNLLEESQNQQERNEKDLLALDSWKNLWNWFNITNWLWYIKLFIMIVGGLIGLRIIFAVLSIVNRVRQGYSPLPFQIRTPNPGGPDRLGRIEEDGGEQDKDRSIRLVSGFLALAWDDLRSLCLFSYHRLRDFILVTARVVELLGRSSLRGLQKGWEALKYLGSLVQYWGLELKKSATSLFDTIAIAVAEGTDRIIELGLSICRAIRHIPRRIRQGFEAALQ

SEQ ID NO: 21 - protein, 820 aa, Human immunodeficiency virus
ATEKLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVEIKPLGVAPTKAKRRVVEREKRAVGIGAVFFGFLGAAGSTMGAASITLTVQARQLLSGIVQQQSNLLRAIEAQQHMLQLTVWGIKQLQTRVLAIERYLKDQQLLGIWGCSGKLICTTTVPWNSSWSNKTQNDIWDNMTWMQWDREINNYTNTIYRLLEESQNQQEKNEQDLLALDKWDNLWSWFSITKWLWYIKIFIMIVGGLIGLRIIFAVLSIVNRVRQGYSPLSFQTLIPSPREPDRPGRIEEEGGEQDRNRSTRLVSGFLALAWDDLRSLCLFSYHLLRDFILIAARTVELLGRSSLRGLQRGWETLKYLGSLVQYWGLELKKSAISLFDTIAIHVAEGTDRIIELVQGICRAIYNIPVRIRQGFEAALQ

SEQ ID NO: 22 - protein, 855 aa, Human immunodeficiency virus
MRVMGIQRNYPPLWRWGTMIFWMMMLCSAEKLWVTVYYGVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSAITQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWTNSTWTNSTTGSNGTESNDTITLQCEIKQFINMWQRVGRAMYAPPIPGVIRCESDITGLLLTRDGPNSTQNETFRPGGGDMRDNWRSELYKYKVVQIEPLGVAPTHAKRRVVEREKRAVGLGAVFFGFLGAAGSTMGAASITLTVQARQLLSGIVQQQSNLLKAIEAQQQLLRLTVWGIKQLQARVLALERYLKDQQLLGIWGCSGKLICTTTVPWNSSWSNKNYTDIWDNMTWLQWDREISNYTDEIYRLIEQSQNQQEKNEQDLLALDKWASLWNWFDITNWLWYIKIFIMIVGGLIGLRIIFTVLNVINRVRQGYSPLSFQTLTHHQREPDRPERIEEGGGEQDRDRSVRLVSGFLALAWDDLRSLCLFSFHRLRDLVLIAARGVELLGHSSLKGLRLGWEALKLLGNLLSYWGQELKNSAINLLDAVAIAVANWTDRVIKIGQRAGRAILNIPIRIRQGLERALL

SEQ ID NO: 23 - protein, 847 aa, Human immunodeficiency virus
MRVKGIRKSYQYLWKGGTLLLGILMICSAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDEVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKRRVVQREKRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDKWASLWNWFDITKWLWYIKIFIMIVGGLVGLRLVFTVLSIVNRVRQGYSPLSFQTLLPAPRGPDRPEGIEEEGGERDRDRSGRLVNGFLALIWVDLRSLCLFSYHRLRDLLLTVTRIVELLGRRGWEVLKYWWNLLQYWSQELKNSAVSLLNATAIAVAEGTDRIIEALQRTYRAILHIPTRIRQGLERALL

SEQ ID NO: 24 - protein, 854 aa, Human immunodeficiency virus
MRVMGIRKNCQRLWRGGTLFLGILMIFSAAENLWVTVYYGVPVWKEATATLFCASDAKAYETEVHNVWATHACVPTDPNPQEVVLENVTENFNMWKNNMVEQMHEDIISLWDQSLKPCVKLTPLCVTLNCTDYLGNATNTTSSSGGAMEGGEIKNCSFNITTSMRDKMQKEYALFYKLDVVSIDNDNASTNYRLISCNTSVITQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKAMYAPPIKGQIRCSSNITGLLLTRDGGSSTNGTTETFRPGGGDMRDNWRSELYKYKVVKIEPLGLAPTRAKRRVVQREKRAVGIGAVFLGFLGAAGSTMGAASMTLTVQARLLLSGIVQQQNNLLRAIEAQQHLLQLTVWGIKQLQARVLAVERYLKDQQLLGIWGCSGKLICTTAVPWNASWSNKSLDKIWNNMTWMEWEREINNYTGLIYNLIEESQNQQEKNEQELLELDKWASLWNWFDITKWLWYIKIFIMIVGGLVGLRIIFTVLSIVNRVRQGYSPLSFQTHLPAPRGPDRPEGIGEEGGEQDRDRSDRLVTGFLAIFWVDLRSLCLFSYHRLRDLLLIVTRIVELLGRRGWEILKYWWNLLQYWNQELKNSAVSLLNATAIVVAEGTDRVIEVLQRAFRAVLNIPTRIRQGLERALL

SEQ ID NO: 25 - protein, 668 aa, Human immunodeficiency virus
MDAMKRGLCCVLLLCGAVFVSPSASVGNLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLSDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTTNNTEIFRPGGGDMRDNWRSELYKYKVVEIKPLGVAPTDAKSSVVESNKSAVGIGAVFLGFLGAAGSTMGAASITLTVQARQLLSGIVQQQSNLLRAIEAQQHMLQLTVWGIKQLQTRVLAIERYLKDQQLLGLWGCSGKLICTTAVPWNISWSNKSKEEIWENMTWMQWDREINNYTNTIYRLLEESQNQQENNEKDLLALDSWNNLWNWFNITNWLWYIK

SEQ ID NO: 26 - protein, 838 aa, Artificial Sequence
  Recombinant HIV-1 Env-ferritin fusion protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 27 - protein, 841 aa, Artificial Sequence
  Recombinant HIV-1 Env-ferritin fusion protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 28 - protein, 825 aa, Artificial Sequence
  Recombinant HIV-1 Env-ferritin fusion protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 29 - protein, 828 aa, Artificial Sequence
  Recombinant HIV-1 Env-ferritin fusion protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 30 - protein, 808 aa, Artificial Sequence
  Recombinant HIV-1 Env-ferritin fusion protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVEIKPLGVAPTKCKRKVVGRRRRRRAVGLGAVLLGFLGAAGSTMGAASITLTVQARQLLSGIVQQQSNLLRAPEAQQHLLQLTVWGIKQLQTRVLAIERYLKDQQLLGLWGCSGKLICCTAVPWNSSWSNKSLGDIWDNMTWMQWDREISNYTNTIFRLLEDSQNQQEKNEKDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 31 - protein, 808 aa, Artificial Sequence
  Recombinant HIV-1 Env-ferritin fusion protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVEIKPLGVAPTECKRRVVGRRRRRRAVGIGAVLLGFLGAAGSTMGAASITLTAQARQVLSGIVQQQSNLLRAPEAQQHLLQLTVWGIKQLQTRVLALERYLKDQQLLGLWGCSGRLICCTAVPWNSSWSNKSLTDIWDNMTWMQWDKEVSNYTNTIYRLLEDSQSQQEKNEKDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 32 - protein, 799 aa, Artificial Sequence
  Recombinant HIV-1 Env-ferritin fusion protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVEIKPLGIAPTECKRRVVGRRRRRRAVGIGAVFLGFLGAAGSTMGAASITLTVQARQLLSGIVQQQSNLLRAPEAQQHMLQLTVWGIKQLQARVLAIERYLKDQQLLGIWGCSGKLICCTNVPWNSSWSNKSLGDIWDNMTWMEWDREISNYTNIIFGLLEDSQNQQERNEKDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 33 - protein, 809 aa, Artificial Sequence
  Recombinant HIV-1 Env-ferritin fusion protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRNELYKYKVVEIKPLGVAPTGCKRKVVGRRRRRRAVGLGAVLFGFLGAAGSTMGAASITLTAQARQLLSGIVQQQSNLLRAPEAQQHMLQLTVWGIKQLQARVLAIERYLKDQQLLGLWGCSGKLICCTNVPWNSSWSNKSQTDIWNNTTWMQWEREISNYTDTIYRLLEDSQNQQEENEKDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 34 - protein, 800 aa, Artificial Sequence
  Recombinant HIV-1 Env-ferritin fusion protein
AENLWVTVYYGVPVWKEAKTTLFCASDAKAYETEVHNIWATHACVPTDPNPQEMELPNVTENFNMWKNDMVDQMHEDIISLWDQSLKPCVKLTPLCVTLNCTITNSSSIMTNCTFNTTTELKDKKRKASASFYRLDIVPLNGDSNGSSSGSYRLINCNTSTCTQACPKVSFDPIPIHYCAPAGYAILKCNDETFNGTGPCHNVSTVQCTHGIKPVVSTQLLLNGSLSEGEIIIRSENLTDNVKTIIVHLNKSIEINCIRTGNNTRRSIRIGPGQTFYATGDIIGDIRKAYCNISKHIWNKTLEEVATKLGAHFINKTIKFAPPSGGDLEITTHSFNCRGEFFYCNTTQLFNNISIGRFNTSIENDTNIILPCRIKQIINMWQEVGRCMYAPPIEGNITCRSNITGILLTRDGGNGGADNSTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 35 - protein, 812 aa, Artificial Sequence
  Recombinant HIV-1 Env-ferritin fusion protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 36 - protein, 797 aa, Artificial Sequence
  Recombinant HIV-1 Env-ferritin fusion protein
AENLWVTVYYGVPVWKEANPTLFCASDAKAYKTEMHNVWATHACVPTDPNPQEMVLENVTEDFNMWKNGMVEQMHQDIISLWDQSLKPCVKLTPLCVTLNCTEVTRSSNGTINNNSTEMKNCSFNVTTDLRDKKKKEHALFYRLDIVPLDETNGTSSEYRLINCNTSTCTQACPKVSFDPIPIHYCAPAGYAILKCKDKKFNGTGPCKNVSTVQCTHGIKPVVSTQLLLNGSIAEGEIIIRSENLTNNAKIIIVQLNVTVEINCTRPNNNTRRSIRIGPGQTFYATGEIIGDIRQAHCNISREKWNRTLQKVEKKLEELFPNKTIHFTSSSGGDLEITTHSFNCMGEFFYCNTSALFNNNNDSTNSNITLPCRIRQFINMWQEVGRCMYAPPIQGVITCKSNVTGLLLTRDGGIINDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 37 - protein, 812 aa, Artificial Sequence
  Recombinant HIV-1 Env-ferritin fusion protein
AENLWVTVYYGVPVWRDADTTLFCASDAKVHSTEVHNVWATHACVPTDPNPQEIHLENVTENFNMWQNKMAEQMQEDVISLWDQSLKPCIKLTPLCVTLSCTEAKFNETFNKIDNITKVSNLTDEMRNCSFNMTTELRDKKQQVYALFYKLDIVPIDNSSEYRLINCNTSVCKQACPKVSFDPIPIHYCTPAGYAILKCNDKNFNGTGPCKNVSSVQCTHGIKPVVSTHLLLNGSLAEEEIVIRSEDITKNTKTIIVHLNKSVEINCTRPSNNTRTSVRIGPGQVFYRTGEVITSIRKAYCEINGTKWNETLRQVAKKLKEHFKNKTIIFQPPSGGDLEVTTHHFNCRGEFFYCDTAQLFNSTWRGNETKEERNGTSNDIIILPCRIKQIVRMWQGVGQCMYAPPISGIINCVSNITGILLTSDGDGGPTADNETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 38 - protein, 807 aa, Artificial Sequence
  Recombinant HIV-1 Env-ferritin fusion protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 39 - protein, 818 aa, Artificial Sequence
  Recombinant HIV-1 Env-ferritin fusion protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 40 - protein, 826 aa, Artificial Sequence
  Recombinant HIV-1 Env-ferritin fusion protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 41 - protein, 809 aa, Artificial Sequence
  Recombinant HIV-1 Env-ferritin fusion protein
AENLWVTVYYGVPVWKDADTTLFCASDAKAHETEAHNIWATHACVPTDPNPQEIYMENVTENFNMWKNNMVEQMQEDIISLWDQSLKPCVKLTHLCVTLSCTNVTLTNVNYTNNFPNIGNITDEVRNCSFNVTTEIRDKKQKVYALFYKTDIVQMENKNSYRLINCNTSVCKQACPKISFDPIPIHYCTPAGYAILKCNEKNFNGTGPCKNVSSVQCTHGIKPVVSTQLLLNGSLAEGEIIIRSENLTNNAKTIIVHLNKSVEINCTRPSNNTRTSVTIGPGQVFYRTGDIIGDIRKAYCEINGTKWNETLKQVVGKLKEHFPNKKISFQPPSGGDLEITMHHFNCRGEFFYCNTTQLFNSTWINSTGIKEYNDTIIYLPCKIKQIINMWQGVGQCMYAPPIRGKINCVSNITGILLTRDGGDANATNDTETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 42 - protein, 805 aa, Artificial Sequence
  Recombinant HIV-1 Env-ferritin fusion protein
AENLWVTVYYGVPVWRDADTTLFCASDAKAQETEAHNIWATHACVPTDPNPQEIHLENVTENFNMWKNNMVEQMQEDVISLWDQSLKPCVKLTPLCVTLNCTTAKVINATIPANVSNIMGNITDEVRNCSFNMTTELRDRKQKAYALFYKLDIVQIKDNKNSSSEYRLINCNTSVCKQACPKVSFDPIPIHYCTPAGYALLKCNDKNFNGTGPCNNVSSVQCTHGIKPVVSTQLLLNGSLAEEEIIISSENLTNNAKTIIVHLNKSVEINCTRPSVNTRTSMHIGPGQVLYRTGDIIGDIRNAYCEIDGTKWSEALELVTEKLKKHFSEIKFQPPSGGDLEITMHHFNCKGEFFYCNTSQLFNNNHKECNGTITLPCRIKQIINMWQGAGQCMYAPPISGKINCVSNITGILLTRDGGTNNNTNSSETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 43 - protein, 796 aa, Artificial Sequence
  Recombinant HIV-1 Env-ferritin fusion protein
AENLWVTVYYGVPVWKEAKATLFCASDARAYEKEVHNVWATHACVPTDPNPQEIYLGNVTENFNMWKNDMVDQMHEDIISLWDQSLKPCVKLTPLCVTLRCTNATINGSLTEEVKNCSFNITTELRDKKQKAYALFYRPDVVPLNKNSPSGNSSEYILINCNTSTCTQACPKVSFDPIPIHYCAPAGYAILKCNNKTFNGTGPCNNVSTVQCTHGIKPVVSTQLLLNGSLAEEDIIIKSENLTNNIKTIIVHLNKSVEIVCRRPNNNTRKSIRIGPGQAFYATNDIIGDIRQAHCNINNSTWNRTLEQIKKKLREHFLNRTIEFEPPSGGDLEVTTHSFNCGGEFFYCNTTRLFKWSSNVTNDTITIPCRIKQFINMWQGAGRCMYAPPIEGNITCNSSITGLLLTRDGGKTDRNDTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 44 - protein, 812 aa, Artificial Sequence
  Recombinant HIV-1 Env-ferritin fusion protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 45 - protein, 814 aa, Artificial Sequence
  Recombinant HIV-1 Env-ferritin fusion protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 46 - protein, 807 aa, Artificial Sequence
  Recombinant HIV-1 Env-ferritin fusion protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 47 - protein, 805 aa, Artificial Sequence
  Recombinant HIV-1 Env-ferritin fusion protein
AENLWVTVYYGVPVWKEAKTTLFCASEAKAYEKEVHNVWATHACVPTDPNPQEMVLENVTENFNMWKNDMVNQMHEDIISLWDQSLKPCVKLTPLCVTLNCTNANGTNNNGTVNVNDTMYGEIKNCSFNMTTELRDKKKQVYALFYKLDIVSLNENSNNSSEYRLINCNTSVCTQACPKVTFDPIPIHYCAPAGYAILKCNNKTFTGIGPCKNVSTVQCTHGIKPVVSTQLLLNGSLAEEEIIVRSENLTDNVKTIIVHLNESVEIVCTRPNNNTRKSVRIGPGQTFYATGAIIGDIRQAHCNISTIKWNKTLQGVEKKLKEHFPNKTIEFKPSSGGDLEITTHSFNCRGEFFCCNTSNLFTSNLFTDNLTNTTNITLPCRIKQIINMWQGVGRCMYAPPIAGNITCKSNITGLLLTRDGGENNRTETFRPGGGDMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 48 - protein, 812 aa, Artificial Sequence
  Recombinant HIV-1 Env-ferritin fusion protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 49 - protein, 809 aa, Artificial Sequence
  Recombinant HIV-1 Env-ferritin fusion protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 50 - protein, 808 aa, Artificial Sequence
  Recombinant HIV-1 Env-ferritin fusion protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 51 - protein, 799 aa, Artificial Sequence
  Recombinant HIV-1 Env-ferritin fusion protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 52 - protein, 812 aa, Artificial Sequence
  Recombinant HIV-1 Env-ferritin fusion protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 53 - protein, 822 aa, Artificial Sequence
  Recombinant HIV-1 Env-ferritin fusion protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 54 - protein, 825 aa, Artificial Sequence
  Recombinant HIV-1 Env-ferritin fusion protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 55 - protein, 809 aa, Artificial Sequence
  Recombinant HIV-1 Env-ferritin fusion protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 56 - protein, 812 aa, Artificial Sequence
  Recombinant HIV-1 Env-ferritin fusion protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 57 - protein, 794 aa, Artificial Sequence
  Recombinant HIV-1 Env-ferritin fusion protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 58 - protein, 797 aa, Artificial Sequence
  Recombinant HIV-1 Env-ferritin fusion protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCNISGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 59 - protein, 809 aa, Artificial Sequence
  Recombinant HIV-1 Env-ferritin fusion protein
AENLWVTVYYGVPVWEDADTPLFCASDAKAYSTESHNVWATHACVPTDPSPQEISLDNVTENFNMWKNNMVEQMHEDIISLWDESLKPCVKLTPLCVTLNCTNVNNSSATNNSMVDDREGLKNCSFNITTELRDKKKQEHALFYRLDIVPINGNSNSNSSVGDYRLINCNVSTCKQACPKMSFDPIPIHYCAPAGFAILKCRDKKFNGTGSCKNVSTVQCTHGIKPVISTQLLLNGSVAEEEIMIRSENFTNNAKNIIVQFNKTIDIMCTRPNNNTRKSISLGPGQAIYATGDIIGNIRQAHCNISGADWGNMIRNVSEKLKEIFNKTTITFKASAGGDLEITTHSFNCRGEFFYCDTSDLFNSSRFNNSSNDTNDTITLPCKIKQIVRMWQRVGQCMYAPPIAGNITCRSNITGLLLTRDGGGNNTNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 60 - protein, 813 aa, Artificial Sequence
  Recombinant HIV-1 Env-ferritin fusion protein
AENLWVTVYYGVPVWEDADTTLFCASDAKAYSTESHNVWATHACVPTDPNPQEIPLKNVTENFNMWKNNMVEQMHEDIISLWDESLKPCVKLTPLCVTLICTNVTSNSTNSTNGVTNNSTVDYREQLKNCSFNITTEIRDKQRKEYALFYRLDIVPINDNEKNDTYRLINCNVSTCKQACPKVTFDPIPIHYCAPAGFAILKCRDKKFNGTGPCKNVSTVQCTHGIKPVISTQLLLNGSLAEGDIMIRSENITDNAKTIIVQLKTAVNITCTRPSNNTRKSIRFGPGQAFYATDEIIGDIRQAHCNISKTEWEDMKRNVSDKLKALFNNKTIIFKSSSGGDLEITTHSFNCRGEFFYCNTSGLFNTSGLFNNNSNDSSGNITLPCKIKQIVRMWQRVGQCMYAPPIAGNITCRSRITGLLLVRDGGKSNETNGTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 61 - protein, 809 aa, Artificial Sequence
  Recombinant HIV-1 Env-ferritin fusion protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 62 - protein, 808 aa, Artificial Sequence
  Recombinant HIV-1 Env-ferritin fusion protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 63 - protein, 808 aa, Artificial Sequence
  Recombinant HIV-1 Env-ferritin fusion protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 64 - protein, 807 aa, Artificial Sequence
  Recombinant HIV-1 Env-ferritin fusion protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 65 - protein, 810 aa, Artificial Sequence
  Recombinant HIV-1 Env-ferritin fusion protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCNISGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 66 - protein, 822 aa, Artificial Sequence
  Recombinant HIV-1 Env-ferritin fusion protein
AENLWVTVYYGVPVWEDADTPLFCASDAKAYSTESHNVWATHACVPTDPSPQEISLDNVTENFNMWKNNMVEQMHEDIISLWDESLKPCVKLTPLCVTLNCTNVNNSSATNNSMVDDREGLKNCSFNITTELRDKKKQEHALFYRLDIVPINGNSNSNSSVGDYRLINCNVSTCKQACPKMSFDPIPIHYCAPAGFAILKCRDKKFNGTGSCKNVSTVQCTHGIKPVISTQLLLNGSVAEEEIMIRSENFTNNAKNIIVQFNKTIDIMCTRPNNNTRKSISLGPGQAIYATGDIIGNIRQAHCNISGADWGNMIRNVSEKLKEIFNKTTITFKASAGGDLEITTHSFNCRGEFFYCDTSDLFNSSRFNNSSNDTNDTITLPCKIKQIVRMWQRVGQCMYAPPIAGNITCRSNITGLLLTRDGGGNNTNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 67 - protein, 826 aa, Artificial Sequence
  Recombinant HIV-1 Env-ferritin fusion protein
AENLWVTVYYGVPVWEDADTTLFCASDAKAYSTESHNVWATHACVPTDPNPQEIPLKNVTENFNMWKNNMVEQMHEDIISLWDESLKPCVKLTPLCVTLICTNVTSNSTNSTNGVTNNSTVDYREQLKNCSFNITTEIRDKQRKEYALFYRLDIVPINDNEKNDTYRLINCNVSTCKQACPKVTFDPIPIHYCAPAGFAILKCRDKKFNGTGPCKNVSTVQCTHGIKPVISTQLLLNGSLAEGDIMIRSENITDNAKTIIVQLKTAVNITCTRPSNNTRKSIRFGPGQAFYATDEIIGDIRQAHCNISKTEWEDMKRNVSDKLKALFNNKTIIFKSSSGGDLEITTHSFNCRGEFFYCNTSGLFNTSGLFNNNSNDSSGNITLPCKIKQIVRMWQRVGQCMYAPPIAGNITCRSRITGLLLVRDGGKSNETNGTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 68 - protein, 822 aa, Artificial Sequence
  Recombinant HIV-1 Env-ferritin fusion protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 69 - protein, 821 aa, Artificial Sequence
  Recombinant HIV-1 Env-ferritin fusion protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 70 - protein, 821 aa, Artificial Sequence
  Recombinant HIV-1 Env-ferritin fusion protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 71 - protein, 825 aa, Artificial Sequence
  Recombinant HIV-1 Env-ferritin fusion protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 72 - protein, 838 aa, Artificial Sequence
  Recombinant HIV-1 Env-ferritin fusion protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 73 - protein, 791 aa, Artificial Sequence
  Recombinant HIV-1 Env-ferritin fusion protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 74 - protein, 794 aa, Artificial Sequence
  Recombinant HIV-1 Env-ferritin fusion protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCNISGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 75 - protein, 806 aa, Artificial Sequence
  Recombinant HIV-1 Env-ferritin fusion protein
AENLWVTVYYGVPVWEDADTPLFCASDAKAYSTESHNVWATHACVPTDPSPQEISLDNVTENFNMWKNNMVEQMHEDIISLWDESLKPCVKLTPLCVTLNCTNVNNSSATNNSMVDDREGLKNCSFNITTELRDKKKQEHALFYRLDIVPINGNSNSNSSVGDYRLINCNVSTCKQACPKMSFDPIPIHYCAPAGFAILKCRDKKFNGTGSCKNVSTVQCTHGIKPVISTQLLLNGSVAEEEIMIRSENFTNNAKNIIVQFNKTIDIMCTRPNNNTRKSISLGPGQAIYATGDIIGNIRQAHCNISGADWGNMIRNVSEKLKEIFNKTTITFKASAGGDLEITTHSFNCRGEFFYCDTSDLFNSSRFNNSSNDTNDTITLPCKIKQIVRMWQRVGQCMYAPPIAGNITCRSNITGLLLTRDGGGNNTNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 76 - protein, 810 aa, Artificial Sequence
  Recombinant HIV-1 Env-ferritin fusion protein
AENLWVTVYYGVPVWEDADTTLFCASDAKAYSTESHNVWATHACVPTDPNPQEIPLKNVTENFNMWKNNMVEQMHEDIISLWDESLKPCVKLTPLCVTLICTNVTSNSTNSTNGVTNNSTVDYREQLKNCSFNITTEIRDKQRKEYALFYRLDIVPINDNEKNDTYRLINCNVSTCKQACPKVTFDPIPIHYCAPAGFAILKCRDKKFNGTGPCKNVSTVQCTHGIKPVISTQLLLNGSLAEGDIMIRSENITDNAKTIIVQLKTAVNITCTRPSNNTRKSIRFGPGQAFYATDEIIGDIRQAHCNISKTEWEDMKRNVSDKLKALFNNKTIIFKSSSGGDLEITTHSFNCRGEFFYCNTSGLFNTSGLFNNNSNDSSGNITLPCKIKQIVRMWQRVGQCMYAPPIAGNITCRSRITGLLLVRDGGKSNETNGTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 77 - protein, 806 aa, Artificial Sequence
  Recombinant HIV-1 Env-ferritin fusion protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 78 - protein, 805 aa, Artificial Sequence
  Recombinant HIV-1 Env-ferritin fusion protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 79 - protein, 804 aa, Artificial Sequence
  Recombinant HIV-1 Env-ferritin fusion protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 80 - protein, 807 aa, Artificial Sequence
  Recombinant HIV-1 Env-ferritin fusion protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCNISGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 81 - protein, 819 aa, Artificial Sequence
  Recombinant HIV-1 Env-ferritin fusion protein
AENLWVTVYYGVPVWEDADTPLFCASDAKAYSTESHNVWATHACVPTDPSPQEISLDNVTENFNMWKNNMVEQMHEDIISLWDESLKPCVKLTPLCVTLNCTNVNNSSATNNSMVDDREGLKNCSFNITTELRDKKKQEHALFYRLDIVPINGNSNSNSSVGDYRLINCNVSTCKQACPKMSFDPIPIHYCAPAGFAILKCRDKKFNGTGSCKNVSTVQCTHGIKPVISTQLLLNGSVAEEEIMIRSENFTNNAKNIIVQFNKTIDIMCTRPNNNTRKSISLGPGQAIYATGDIIGNIRQAHCNISGADWGNMIRNVSEKLKEIFNKTTITFKASAGGDLEITTHSFNCRGEFFYCDTSDLFNSSRFNNSSNDTNDTITLPCKIKQIVRMWQRVGQCMYAPPIAGNITCRSNITGLLLTRDGGGNNTNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 82 - protein, 823 aa, Artificial Sequence
  Recombinant HIV-1 Env-ferritin fusion protein
AENLWVTVYYGVPVWEDADTTLFCASDAKAYSTESHNVWATHACVPTDPNPQEIPLKNVTENFNMWKNNMVEQMHEDIISLWDESLKPCVKLTPLCVTLICTNVTSNSTNSTNGVTNNSTVDYREQLKNCSFNITTEIRDKQRKEYALFYRLDIVPINDNEKNDTYRLINCNVSTCKQACPKVTFDPIPIHYCAPAGFAILKCRDKKFNGTGPCKNVSTVQCTHGIKPVISTQLLLNGSLAEGDIMIRSENITDNAKTIIVQLKTAVNITCTRPSNNTRKSIRFGPGQAFYATDEIIGDIRQAHCNISKTEWEDMKRNVSDKLKALFNNKTIIFKSSSGGDLEITTHSFNCRGEFFYCNTSGLFNTSGLFNNNSNDSSGNITLPCKIKQIVRMWQRVGQCMYAPPIAGNITCRSRITGLLLVRDGGKSNETNGTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 83 - protein, 819 aa, Artificial Sequence
  Recombinant HIV-1 Env-ferritin fusion protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 84 - protein, 818 aa, Artificial Sequence
  Recombinant HIV-1 Env-ferritin fusion protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 85 - protein, 549 aa, Influenza virus
DTICIGYHANNSTDTVDTVLEKNVTVTHSVNLLEDSHNGKLCKLKGIAPLQLGKCNIAGWLLGNPECDLLLTASSWSYIVETSNSENGTCYPGDFIDYEELREQLSSVSSFEKFEIFPKTSSWPNHETTKGVTAACSYAGASSFYRNLLWLTKKGSSYPKLSKSYVNNKGKEVLVLWGVHHPPTGTDQQSLYQNADAYVSVGSSKYNRRFTPEIAARPKVRDQAGRMNYYWTLLEPGDTITFEATGNLIAPWYAFALNRGSGSGIITSDAPVHDCNTKCQTPHGAINSSLPFQNIHPVTIGECPKYVRSTKLRMATGLRNIPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDIWTYNAELLVLLENERTLDFHDSNVRNLYEKVKSQLKNNAKEIGNGCFEFYHKCDDACMESVRNGTYDYPKYSEESKLNREEIDGVKLESMGVYQILAIYSTVASSLVLLVSLGAISFWMCSNGSLQCRICI

SEQ ID NO: 86 - protein, 548 aa, Influenza virus
DTICIGYHANNSTDTVDTVLEKNVTVTHSVNLLENSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGESSFYRNLLWLTGKNGLYPNLSKSYANNKEKEVLVLWGVHHPPNIGNQKALYHTENAYVSVVSSHYSRKFTPEIAKRPKVRDQEGRINYYWTLLEPGDTIIFEANGNLIAPRYAFALSRGFGSGIINSNAPMDKCDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 87 - protein, 548 aa, Influenza virus
DTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 88 - protein, 548 aa, Influenza virus
DTICIGYHANNSTDTVDTVLEKNVTVTHSVNLLEDSHNGKLCRLKGIAPLQLGKCNIAGWLLGNPECDPLLPVRSWSYIVETPNSENGICYPGDFIDYEELREQLSSVSSFERFEIFPKESSWPNHNTNGVTAACSHEGKSSFYRNLLWLTEKEGSYPKLKNSYVNKKGKEVLVLWGIHHPPNSKEQQNLYQNENAYVSVVTSNYNRRFTPEIAERPKVRDQAGRMNYYWTLLKPGDTIIFEANGNLIAPMYAFALSRGFGSGIITSNASMHECNTKCQTPLGAINSSLPYQNIHPVTIGECPKYVRSAKLRMVTGLRNIPSIQSRGLFGAIAGFIEGGWTGMIDGWYGYHHQNEQGSGYAADQKSTQNAINGITNKVNTVIEKMNIQFTAVGKEFNKLEKRMENLNKKVDDGFLDIWTYNAELLVLLENERTLDFHDSNVKNLYEKVKSQLKNNAKEIGNGCFEFYHKCDNECMESVRNGTYDYPKYSEESKLNREKVDGVKLESMGIYQILAIYSTVASSLVLLVSLGAISFWMCSNGSLQCRICI

SEQ ID NO: 89 - protein, 548 aa, Influenza virus
DTICIGYHANNSTDTVDTVLEKNVTVTHSVNLLEDSHNGKLCLLKGIAPLQLGNCSVAGWILGNPECELLISRESWSYIVEKPNPENGTCYPGHFADYEELREQLSSVSSFERFEIFPKESSWPNHTTTGVSASCSHNGESSFYKNLLWLTGKNGLYPNLSKSYANNKEKEVLVLWGVHHPPNIGDQRALYHTENAYVSVVSSHYSRKFTPEIAKRPKVRDREGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSRVLLVSLGAISFWMCSNGSLQCRICI

SEQ ID NO: 90 - protein, 549 aa, Influenza virus; identical to SEQ ID NO: 85

SEQ ID NO: 91 - protein, 547 aa, Influenza virus
DQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAQGSYNNTSGEQMLIIWGVHHPNDETEQRTLYQNVGTYVSVGTSTLNKRSTPEIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 92 - protein, 547 aa, Influenza virus
DQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGQGGRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 93 - protein, 550 aa, Influenza virus
QDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGIHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEEMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 94 - protein, 550 aa, Influenza virus
QKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQSGESYACKRGSVKSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVNGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 95 - protein, 550 aa, Influenza virus
QDLPGNDNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 96 - protein, 550 aa, Influenza virus
QKLPGNDNSTATLCLGHHAVPNGTIVKTITNDQIEVTNATELVQSSSTGEICDSPHQILDGKNCTLIDALLGDPQCDGFQNKKWDLFVERSKAYSNCYPYDVPDYASLRSLVASSGTLEFNNESFNWTGVTQNGTSSACIRRSKNSFFSRLNWLTHLNFKYPALNVTMPNNEQFDKLYIWGVHHPGTDKDQIFLYAQASGRITVSTKRSQQTVSPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 97 - protein, 550 aa, Influenza virus
QKLPGNDNSTATLCLGHHAVPNGTIVKTITNDQIEVTNATELVQSSSTGEICNSPHQILDGENCTLIDALLGDPQCDGFQNKKWDLFVERSKAHSNCYPYDVPDYASLRSLVASSGTLEFNNESFNWTGVTQNGTSSACIRRSNNSFFSRLNWLTHLNFKYPALNVTMPNNEQFDKLYIWGVHHPGTDKDQIFLYAQAAGRITVSTKRSQQAVIPNIGSRPRVRNIPSRVSIYWTIVKPGDILLINSTGNLIAPRGYFKIRSGKSSIMRSDAPIGKCNSACITPNGSIPNDKPFQNVNRITYGACPRYVKQNTLKLATGMRNVPEKQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 98 - protein, 550 aa, Influenza virus
QKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNDESFNWTGVTQNGTSSSCKRRSNNSFFSRLNWLTHLKFKYPALNVTMPNNEKFDKLYIWGVHHPVTDNDQIFLYAQASGRITVSTKRSQQTVIPNIGSRPRIRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 99 - protein, 548 aa, Influenza virus
QNYTGNPVICMGHHAVANGTMVKTLADDQVEVVTAQELVESQNLPELCPSPLRLVDGQTCDIINGALGSPGCDHLNGAEWDVFIERPNAVDTCYPFDVPEYQSLRSILANNGKFEFIAEEFQWNTVKQNGKSGACKRANVDDFFNRLNWLVKSDGNAYPLQNLTKINNGDYARLYIWGVHHPSTSTEQTNLYKNNPGRVTVSTKTSQTSVVPDIGSRPLVRGQSGRVSFYWTIVEPGDLIVFNTIGNLIAPRGHYKLNNQKKSTILNTAIPIGSCVSKCHTDKGSLSTTKPFQNISRIAVGDCPRYVKQGSLKLATGMRNIPEKASRGLFGAIAGFIENGWQGLIDGWYGFRHQNAEGTGTAADLKSTQAAIDQINGKLNRLIEKTNDKYHQIEKEFEQVEGRIQDLENYVEDTKIDLWSYNAELLVALENQHTIDVTDSEMNKLFERVRRQLRENAEDKGNGCFEIFHKCDNNCIESIRNGTYDHDIYRDEAINNRFQIQGVKLTQGYKDIILWISFSISCFLLVALLLAFILWACQNGNIRCQICI

SEQ ID NO: 100 - protein, 551 aa, Influenza virus
DQICIGYHANNSTEQVDTIMEKNVTVTHAQDILEKTHNGKLCDLDGVKPLILRDCSVAGWLLGNPMCDEFINVPEWSYIVEKANPANDLCYPGNFNDYEELKHLLSRINHFEKIQIIPKSSWSDHEASSGVSSACPYQGTPSFFRNVVWLIKKNNTYPTIKRSYNNTNQEDLLILWGIHHSNDAAEQTKLYQNPTTYISVGTSTLNQRLVPKIATRSKVNGQSGRMDFFWTILKPNDAINFESNGNFIAPEYAYKIVKKGDSAIVKSEVEYGNCNTKCQTPIGAINSSMPFHNIHPLTIGECPKYVKSNKLVLATGLRNSPLRERRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 101 - protein, 551 aa, Influenza virus
DQICIGYHANNSTEQVDTIMEKNVTVTHAQDILEKTHNGKLCDLDGVKPLILRDCSVAGWLLGNPMCDEFINVPEWSYIVEKANPPNDLCYPGNFNDYEELKHLLSRINHFEKIQIIPKSSWSDHEASSGVSSACPYQGRSSFFRNVVWLIKKNSAYPTIKRSYNNTNQEDLLVLWGIHHPNDAAEQTRLYQNPTTYISVGTSTLNQRLVPKIATRSKVNGQSGRMEFFWTILKPNDAISFESNGNFIAPEYAYKIVKKGDSAIMKSELEYGNCNTKCQTPMGAINSSMPFHNIHPLTIGECPKYVKSSRLVLATGLRNSPQREKRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECIESVRNGTYGYPQYSEEARLKREEISGVKLESIGTYQILSIYSTVASSLALAIMVAGLSLWMCSNGSLQCRICI

SEQ ID NO: 102 - protein, 552 aa, Influenza virus
DQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 103 - protein, 552 aa, Influenza virus
DQICIGYHANNSTEQVDTIMEKNVTVTHAQDILEKTHNGKLCDLDGVKPLILRDCSVAGWLLGNPMCDEFINVPEWSYIVEKANPANDLCYPGDFNDYEELKHLLSRINHFEKIQIIPKNSWSSHEASLGVSSACPYQGKSSFFRNVVWLIKKNNAYPTIKRSYNNTNQEDLLVLWGIHHPNDAAEQTRLYQNPTTYISVGTSTLNQRLVPKIATRSKVNGQNGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGTYQILSIYSTVASSLALAIMVAGLSLWMCSNGSLQCRICI

SEQ ID NO: 104 - protein, 553 aa, Influenza virus
DQICIGYHANNSTEQVDTIMEKNVTVTHAQDILEKTHNGKLCDLDGVKPLILRDCSVAGWLLGNPMCDEFINVPEWSYIVEKANPTNDLCYPGSFNDYEELKHLLSRINHFEKIQIIPKSSWSDHEASSGVSSACPYLGSPSFFRNVVWLIKKNSTYPTIKKSYNNTNQEDLLVLWGIHHPNDAAEQTRLYQNPTTYISIGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNSPQRESRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESIRNGTYNYPQYSEEARLKREEISGVKLESIGTYQILSIYSTVASSLALAIMMAGLSLWMCSNGSLQCRICIK

SEQ ID NO: 105 - protein, 552 aa, Influenza virus
DQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASAGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSSRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 106 - protein, 549 aa, Influenza virus
DQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCR

SEQ ID NO: 107 - protein, 552 aa, Influenza virus
DQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRRKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 108 - protein, 550 aa, Influenza virus
DKICIGYHANNSTTQIDTILEKNVTVTHSVELLENQKEERFCKILKKAPLDLKGCTIEGWILGNPQCDLLLGDQSWSYIVERPTAQNGICYPGVLNEVEELKALIGSGERVERFEMFPKSTWTGVDTSSGVTRACPYNSGSSFYRNLLWIIKTKSAAYSVIKGAYNNTGNQPILYFWGVHHPPDTDEQNTLYGSGDRYVRMGTESMNFAKSPEIAARPAVNGQRGRIDYCWSILKPGETLNVESNGNLIAPWYAFRFVSTSNKGAVFKSNLPIENCDATCQTVAGVLRTNKTFQNVSPLWIGECPKYVKSESLRLATGLRNVPQIETRGLFGAIAGFIEGGWTGMIDGWYGYHHENSQGSGYAADRESTQKAVDGITNKVNSIIDKMNTQFEAVDHEFSNLERRIDNLNKRMEDGFLDVWTYNAELLVLLENERTLDLHDANVKNLYERVKSQLRDNAMILGNGCFEFWHKCDDECMESVKNGTYDYPKYQDESKLNRQEIESVKLESLGVYQILAIYSTVSSSLVLVGLIIAVGLWMCSNGSMQCRICI

SEQ ID NO: 109 - protein, 546 aa, Influenza virus
DKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKEAMGFTYSGIRTNGTTSTCRRSGSSFYAEMKWLLSNTDNAAFPQMTKSYKNTRKDPALIIWGIHHSGSTTEQTKLYGSGNKLITVGSSNYQQSFVPSPGERPQVNGQSGRIDFHWLMLNPNDTVTFSFNGAFIAPDRASFLRGKSMGIQSGVQVDANCEGDCYHSGGTIISNLPFQNINSRAVGKCPRYVKQESLLLATGMKNVPEIPKGSRVRRGLFGAIAGFIENGWEGLIDGWYGFRHQNAQGEGTAADYKSTQSAIDQVTGKLNRLIEKTNQQFELIDNEFTEVEKQIGNVINWTRDSMTEVWSYNAELLVAMENQHTIDLTDSEMNKLYERVKRLLRENAEEDGTGCFEIFHKCDDDCMASIRNNTYDHSKYREEAMQNRIQIDPVKLSSGYKDVILWFSFGASCFILLAIAMGLVFICVRNGNMRCTICI

SEQ ID NO: 110 - protein, 549 aa, Influenza virus
DKICLGHHAVANGTKVNTLTERGIEVVNATETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKQAYQKRMTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 111 - protein, 549 aa, Influenza virus; identical to SEQ ID NO: 110

SEQ ID NO: 112 - protein, 544 aa, Influenza virus
DKICLGHHAVSNGTKVNTLTERGVEVVNATETVERTNVPRICSKGKRTVDLGQCGLLGTITGPPQCDQFLEFSADLIIERREGSDVCYPGKFVNEEALRQILRESGGIDKETMGFTYSGIRTNGTTSACRRSGSSFYAEMKWLLSNTDNAAFPQMTKSYKNTRKDPALIIWGIHHSGSTTEQTKLYGSGNKLITVGSSNYQQSFVPSPGARPQVNGQSGRIDFHWLILNPNDTVTFSFNGAFIAPDRASFLRGKSMGIQSEVQVDANCEGDCYHSGGTIISNLPFQNINSRAVGKCPRYVKQESLLLATGMKNVPEIPKRRRRGLFGAIAGFIENGWEGLIDGWYGFRHQNAQGEGTAADYKSTQSAIDQITGKLNRLIEKTNQQFELIDNEFTEVERQIGNVINWTRDSMTEVWSYNAELLVAMENQHTIDLADSEMNKLYERVKRQLRENAEEDGTGCFEIFHKCDDDCMASIRNNTYDHSKYREEAIQNRIQIDPVKLSSGYKDVILWFSFGASCFILLAIAMGLVFICVKNGNMRCTICI

SEQ ID NO: 113 - protein, 542 aa, Influenza virus
DKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTDGATSACRRSGSSFYAEMKWLLSNTDDAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDPVKLSSGYKDVILWFSFGASCFILLAIVMGLVFICVKNGNMRCTICI

SEQ ID NO: 114 - protein, 542 aa, Influenza virus
DKICIGHQSTNSTETVDTLTETNVPVTHAKELLHTEHNGMLCATSLGHPLILDTCTIEGLVYGNPSCDLLLGGREWSYIVERSSAVNGTCYPGNVENLEELRTLFSSASSYQRIQIFPDTTWNVTYTGTSRACSGSFYRSMRWLTQKSGFYPVQDAQYTNNRGKSILFVWGIHHPPTYTEQTNLYIRNDTTTSVTTEDLNRTFKPVIGPRPLVNGLQGRIDYYWSVLKPGQTLRVRSNGNLIAPWYGHVLSGGSHGRILKTDLKGGNCVVQCQTEKGGLNSTLPFHNISKYAFGTCPKYVRVNSLKLAVGLRNVPARSSRGLFGAIAGFIEGGWPGLVAGWYGFQHSNDQGVGMAADRDSTQKAIDKITSKVNNIVDKMNKQYEIIDHEFSEVETRLNMINNKIDDQIQDVWAYNAELLVLLENQKTLDEHDANVNNLYNKVKRALGSNAMEDGKGCFELYHKCDDQCMETIRNGTYNRRKYREESRLERQKIEGVKLESEGTYKILTIYSTVASSLVLAMGFAAFLFWAMSNGSCRCNICI

SEQ ID NO: 115 - protein, 544 aa, Influenza virus
DKICLGHHAVANGTIVKTLTNVQEEVTNATETVESTSLNRLCMKGRSYKDLGNCHPIGMLIGTPACDLHLTGTWDTLIERKNAIAYCYPGTTINEGALRQKIMESGGISKTSTGFAYGSSINSAGTTKACMRNGGDSFYAEVKWLVSKDKGQNFPQTTNTYRNTDTAEHLIIWGIHHPSSTQEKNDLYGTQSLSISVGSSTYQNNFVPVVRARPQVNGQSGRIDFHWTLVQPGDNITFSHNGGRIAPSRVSKLVGRGLGIQSEASIDNGCESKCFWRGGSINTKLPFQNLSPRTVGQCPKYVNKKSLMLATGMRNVPEIMQGRGLFGAIAGFIENGWEGMVDGWYGFRHQNAQGTGQAADYKSTQAAIDQITGKLNRLIEKTNTEFESIESEFSEIEHQIGNVINWTKDSITDIWTYQAELLVAMENQHTIDMADSEMLNLYERVRKQLRQNAEEDGKGCFEIYHTCDDSCMESIRNNTYDHSQYREEALLNRLNINSVKLSSGYKDIILWFSFGASCFVLLAAVMGLVFFCLKNGNMQCTICI

SEQ ID NO: 116 - protein, 544 aa, Influenza virus; identical to SEQ ID NO: 115

SEQ ID NO: 117 - protein, 549 aa, Influenza virus
DEICIGYLSNNSTEKVDTIIESNVTVTSSVELVENEYTGSFCSIDGKAPISLGDCSFAGWILGNPMCDDLIGKTSWSYIVEKPNPINGICYPGTLENEEELRLKFSGVLEFNKFEAFTSNGWGSVNSGAGVTAACKFGSSNSFFRNMVWLIHQSGTYPVIRRTFNNTKGRDVLMVWGVHHPATLKEHQDLYKKDNSYVAVGSESYNRRFTPEISTRPKVNGQAGRMTFYWTIVKPEEAITFESNGAFLAPRYAFELVSLGNGKLFRSDLNIESCSTKCQSEIGWINTNRSFHSVHRNTIGDCPKYVNVKSLKLATGLRNVPAIAARGLFGAIAGFIEGGWPGLINGWYGFQHRNEEGTGIAADKESTQTAIDQITSKVNNIVDRMNTNFESVQHEFSEIEERINQLSKHVDDSVIDIWSYNAQLLVLLENEKTLDLHDSNVRNLHEKVRRMLKDNAKDEGNGCFTFYHKCDNECIEKVRNGTYDHKEFEEESRLNRQEIEGVKLDSSGNVYKILSIYSCIASSLVLAAIIMGFIFWACSNGSCRCTICI

SEQ ID NO: 118 - protein, 547 aa, Influenza virus
DKICIGYQTNNSTETVNTLSEQNVPVTQVEELVHRGIDPILCGTELGSPLVLDDCSLEGLILGNPKCDLYLNGREWSYIVERPKEMEGVCYPGSIENQEELRSLFSSIKKYERVKMFDFTKWNVTYTGTSKACNNTSNQGSFYRSMRWLTLKSGQFPVQTDEYKNTRDSDIVFTWAIHHPPTSDEQVKLYKNPDTLSSVTTVEINRSFKPNIGPRPLVRGQQGRMDYYWAVLKPGQTVKIQTNGNLIAPEYGHLITGKSHGRILKNNLPMGQCVTECQLNEGVMNTSKPFQNTSKHYIGKCPKYIPSGSLKLAIGLRNVPQVQDRGLFGAIAGFIEGGWPGLVAGWYGFQHQNAEGTGIAADRDSTQRAIDNMQNKLNNVIDKMNKQFEVVNHEFSEVESRINMINSKIDDQITDIWAYNAELLVLLENQKTLDEHDANVRNLHDRVRRVLRENAIDTGDGCFEILHKCDNNCMDTIRNGTYNHKEYEEESKIERQKVNGVKLEENSTYKILSIYSSVASSLVLLLMIIGGFIFGCQNGNVRCTFCI

SEQ ID NO: 119 - protein, 548 aa, Influenza virus
DRICVGYLSTNSSERVDTLLENGVPVTSSIDLIETNHTGTYCSLNGVSPVHLGDCSFEGWIVGNPACTSNFGIREWSYLIEDPAAPHGLCYPGELNNNGELRHLFSGIRSFSRTELIPPTSWGEVLDGTTSACRDNTGTNSFYRNLVWFIKKNNRYPVISKTYNNTTGRDVLVLWGIHHPVSVDETKTLYVNSDPYTLVSTKSWSEKYKLETGVRPGYNGQRSWMKIYWSLIHPGEMITFESNGGFLAPRYGYIIEEYGKGRIFQSRIRMSRCNTKCQTSVGGINTNRTFQNIDKNALGDCPKYIKSGQLKLATGLRNVPAISNRGLFGAIAGFIEGGWPGLINGWYGFQHQNEQGTGIAADKESTQKAIDQITTKINNIIDKMNGNYDSIRGEFNQVEKRINMLADRIDDAVTDIWSYNAKLLVLLENDKTLDMHDANVKNLHEQVRRELKDNAIDEGNGCFELLHKCNDSCMETIRNGTYDHTEYAEESKLKRQEIDGIKLKSEDNVYKALSIYSCIASSVVLVGLILSFIMWACSSGNCRFNVCI

SEQ ID NO: 120 - protein, 551 aa, Influenza virus
QITNGTTGNPIICLGHHAVENGTSVKTLTDNHVEVVSAKELVETNHTDELCPSPLKLVDGQDCHLINGALGSPGCDRLQDTTWDVFIERPTAVDTCYPFDVPDYQSLRSILASSGSLEFIAEQFTWNGVKVDGSSSACLRGGRNSFFSRLNWLTKATNGNYGPINVTKENTGSYVRLYLWGVHHPSSDNEQTDLYKVATGRVTVSTRSDQISIVPNIGSRPRVRNQSGRISIYWTLVNPGDSIIFNSIGNLIAPRGHYKISKSTKSTVLKSDKRIGSCTSPCLTDKGSIQSDKPFQNVSRIAIGNCPKYVKQGSLMLATGMRNIPGKQAKGLFGAIAGFIENGWQGLIDGWYGFRHQNAEGTGTAADLKSTQAAIDQINGKLNRLIEKTNEKYHQIEKEFEQVEGRIQDLEKYVEDTKIDLWSYNAELLVALENQHTIDVTDSEMNKLFERVRRQLRENAEDQGNGCFEIFHQCDNNCIESIRNGTYDHNIYRDEAINNRIKINPVTLTMGYKDIILWISFSMSCFVFVALILGFVLWACQNGNIRCQICI

SEQ ID NO: 121 - protein, 552 aa, Influenza virus
DKICLGHHAVANGTKVNTLTERGVEVVNATETVEITGIDKVCTKGKKAVDLGSCGILGTIIGPPQCDLHLEFKADLIIERRNSSDICYPGRFTNEEALRQIIRESGGIDKESMGFRYSGIRTDGATSACKRTVSSFYSEMKWLSSSMNNQVFPQLNQTYRNTRKEPALIVWGVHHSSSLDEQNKLYGTGNKLITVGSSKYQQSFSPSPGARPKVNGQAGRIDFHWMLLDPGDTVTFTFNGAFIAPDRATFLRSNAPSGIEYNGKSLGIQSDAQIDESCEGECFYSGGTINSPLPFQNIDSRAVGKCPRYVKQSSLPLALGMKNVPEKIRTRGLFGAIAGFIENGWEGLIDGWYGFRHQNAQGQGTAADYKSTQAAIDQITGKLNRLIEKTNKQFELIDNEFTEVEQQIGNVINWTRDSLTEIWSYNAELLVAMENQHTIDLADSEMNKLYERVRRQLRENAEEDGTGCFEIFHRCDDQCMESIRNNTYNHTEYRQEALQNRIMINPVKLSSGYKDVILWFSFGASCVMLLAIAMGLIFMCVKNGNLRCTICI

SEQ ID NO: 122 - protein, 546 aa, Influenza virus
DKICIGYLSNNSTDTVDTLTENGVPVTSSIDLVETNHTGTYCSLNGVSPIHLGDCSFEGWIVGNPSCASNINIREWSYLIEDPNAPHKLCFPGEVDNNGELRHLFSGVNSFSRTELIPPSKWGDILEGTTASCQNRGANSFYRNLIWLVNKLNKYPVVKGEYNNTTGRDVLVLWGIHHPDTEATANKLYVNKNPYTLVSTKEWSRRYELEIGTRIGDGQRSWMKIYWHLMHPGERITFESSGGLLAPRYGYIIEKYGTGRIFQSGVRLAKCNTKCQTSMGGINTNKTFQNIERNALGDCPKYIKSGQLKLATGLRNVPSIVERGLFGAIAGFIEGGWPGLINGWYGFQHQNEQGTGIAADKTSTQKAINEITTKINNIIEKMNGNYDSIRGEFNQVEKRINMIADRVDDAVTDIWSYNAKLLVLIENDRTLDLHDANVRNLHEQIKRALKDNAIDEGDGCFSILHKCNDSCMETIRNGTYNHEDYKEESQLKRQEIEGIKLKTEDNVYKILSIYSCIASSVVLVGLILAFILWACSSGNCRFNVCI

SEQ ID NO: 123 - protein, 546 aa, Influenza virus
DRICIGYQANQNNQTVNTLLEQNVPVTGAQEILETNHNGKLCSLNGVPPLDLQSCTLAGWLLGNPNCDNLLEAEEWSYIKINENAPDDLCFPGNFENLQDLLLEMSGVQNFTKVKLFNPQSMTGVTTNNVDQTCPFEGKPSFYRNLNWIQGNSGLPFNIEIKNPTSNPLLLLWGIHNTKDAAQQRNLYGNDYSYTIFNFGEKSEEFRPDIGQRDEIKAHQDRIDYYWGSLPAQSTLRIESTGNLIAPEYGFYYKRKEGKGGLMKSKLPISDCSTKCQTPLGALNSTLPFQNVHQQTIGNCPKYVKATSLMLATGLRNNPQMEGRGLFGAIAGFIEGGWQGMIDGWYGYHHENQEGSGYAADKEATQKAVDAITNKVNSIIDKMNSQFESNIKEFNRLELRIQHLSDRVDDALLDIWSYNTELLVLLENERTLDFHDANVKNLFEKVKAQLKDNAIDEGNGCFLLLHKCNNSCMDDIKNGTYKYMDYREESHIEKQKIDGVKLTDYSRYYTMTLYSTIASSVVLGSLIIAAFLWGCQKGSIQCKICI

SEQ ID NO: 124 - protein, 547 aa, Influenza virus
DQICIGYHSNNSTQTVNTLLESNVPVTSSHSILEKEHNGLLCKLKGKAPLDLIDCSLPAWLMGNPKCDELLTASEWAYIKEDPEPENGICFPGDFDSLEDLILLVSNTDHFRKEKIIDMTRFSDVTTNNVDSACPYDTNGASFYRNLNWVQQNKGKQLIFHYQNSENNPLLIIWGVHQTSNAAEQNTYYGSQTGSTTITIGEETNTYPLVISESSILNGHSDRINYFWGVVNPNQNFSIVSTGNFIWPEYGYFFQKTTNISGIIKSSEKISDCDTICQTKIGAINSTLPFQNIHQNAIGDCPKYVKAQELVLATGLRNNPIKETRGLFGAIAGFIEGGWQGLIDGWYGYHHQNSEGSGYAADKEATQKAVDAITTKVNNIIDKMNTQFESTAKEFNKIEMRIKHLSDRVDDGFLDVWSYNAELLVLLENERTLDFHDANVNNLYQKVKVQLKDNAIDMGNGCFKILHKCNNTCMDDIKNGTYNYYEYRKESHLEKQKIDGVKLSENSSYKIMIIYSTVASSVVLGLIILAAIEWGCFKGNLQCRICI

SEQ ID NO: 125 - protein, 569 aa, Influenza virus
DRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYENIRLSTQNVIDAEKAPGGPYRLGTSGSCPNATSKIGFFATMAWAVPKDNYKNATNPLTVEVPYICKEEEDQITVWGFHSDNKTQMKNLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 126 - protein, 570 aa, Influenza virus
DRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNVTNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAASLNDDGLDNHTILLYYSTAASSLAVTLMIAIFVVYMVSRDNVSCSICL

SEQ ID NO: 127 - protein, 569 aa, Influenza virus
DRICTGITSSNSPHVVKTATQGEVNVTGVIPLTTTPTKSYFANLKGTKTRGKLCPDCLNCTDLDVALGRPMCVGTTPSAKASILHEVRPVTSGCFPIMHDRTKIRQLANLLRGYENIRLSTQNVIDAEKAPGGPYRLGTSGSCPNATSKSGFFATMAWAVPKDNNKNATNPLTVEVPYICAEGEDQITVWGFHSDDKTQMKNLYGDSNPQKFTSSANGVTTHYVSQIGGFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 128 - protein, 569 aa, Influenza virus
DRICTGITSSNSPHVVKTATQGEVNVTGVIPLTTTPTKSYFANLKGTRTRGKLCPDCLNCTDLDVALGRPMCVGTTPSAKASILHEVKPVTSGCFPIMHDRTKIRQLPNLLRGYENIRLSTQNVIDAEKAPGGPYRLGTSGSCPNATSKSGFFATMAWAVPKDNNKNATNPLTVEVPYICTEGEDQITVWGFHSDDKTQMKNLYGDSNPQKFTSSANGVTTHYVSQIGSFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFNAGEFSLPTFDSLNITAASLNDDGLDNHTILLYYSTAASSLAVTLMLAIFIVYMVSRDNVSCSICL

SEQ ID NO: 129 - protein, 679 aa, Artificial Sequence
  Recombinant influenza HA-ferritin fusion protein
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 130 - protein, 673 aa, Artificial Sequence
  Recombinant influenza HA-ferritin fusion protein
DKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 131 - protein, 679 aa, Artificial Sequence
  Recombinant influenza HA-ferritin fusion protein
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 132 - protein, 671 aa, Artificial Sequence
  Recombinant influenza HA-ferritin fusion protein
ATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 133 - protein, 698 aa, Artificial Sequence
  Recombinant influenza HA-ferritin fusion protein
DRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFDAGEFSLPTFDSLNITAGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 134 - protein, 699 aa, Artificial Sequence
  Recombinant influenza HA-ferritin fusion protein
DRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 135 - protein, 689 aa, Artificial Sequence
  Recombinant influenza HA-ferritin fusion protein
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADTYVFVGSSRYSKKFKPEIAIRPKVRDQEGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 136 - protein, 683 aa, Artificial Sequence
  Recombinant influenza HA-ferritin fusion protein
DKICLGHHAVSNGTKVNTLTERGVEVVNATETVERTNIPRICSKGKRTVDLGQCGLLGTITGPPQCDQFLEFSADLIIERREGSDVCYPGKFVNEEALRQILRESGGIDKEAMGFTYSGIRTNGATSACRRSGSSFYAEMKWLLSNTDNAAFPQMTKSYKNTRKSPALIVWGIHHSVSTAEQTKLYGSGNKLVTVGSSNYQQSFVPSPGARPQVNGLSGRIDFHWLMLNPNDTVTFSFNGAFIAPDRASFLRGKSMGIQSGVQVDANCEGDCYHSGGTIISNLPFQNIDSRAVGKCPRYVKQRSLLLATGMKNVPEIPKGRGLFGAIAGFIENGWEGLIDGWYGFRHQNAQGEGTAADYKSTQSAIDQITGKLNRLIEKTNQQFELIDNEFNEVEKQIGNVINWTRDSITEVWSYNAELLVAMENQHTIDLADSEMDKLYERVKRQLRENAEEDGTGCFEIFHKCDDDCMASIRNNTYDHSKYREEAMQNRIQIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 137 - protein, 689 aa, Artificial Sequence
  Recombinant influenza HA-ferritin fusion protein
DTLCIGYHANNSTDTVDTVLEKNVTVTHSVNLLEDKHNGKLCKLRGVAPLHLGKCNIAGWILGNPECESLSTASSWSYIVETPSSDNGTCYPGDFIDYEELREQLSSVSSFERFEIFPKTSSWPNHDSNKGVTAACPHAGAKSFYKNLIWLVKKGNSYPKLSKSYINDKGKEVLVLWGIHHPSTSADQQSLYQNADAYVFVGSSRYSKKFKPEIAIRPKVRDREGRMNYYWTLVEPGDKITFEATGNLVVPRYAFAMERNAGSGIIISDTPVHDCNTTCQTPKGAINTSLPFQNIHPITIGKCPKYVKSTKLRLATGLRNIPSIQSRGLFGAIAGFIEGGWTGMVDGWYGYHHQNEQGSGYAADLKSTQNAIDEITNKVNSVIEKMNTQFTAVGKEFNHLEKRIENLNKKVDDGFLDIWTYNAELLVLLENERTLDYHDSNVKNLYEKVRSQLKNNAKEIGNGCFEFYHKCDNTCMESVKNGTYDYPKYSEEAKLNREEIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 138 - protein, 681 aa, Artificial Sequence
  Recombinant influenza HA-ferritin fusion protein
ATLCLGHHAVPNGTIVKTITNDRIEVTNATELVQNSSIGEICDSPHQILDGENCTLIDALLGDPQCDGFQNKKWDLFVERSKAYSNCYPYDVPDYASLRSLVASSGTLEFNNESFNWAGVTQNGTSSSCIRGSNSSFFSRLNWLTHLNSKYPALNVTMPNNEQFDKLYIWGVHHPGTDKDQIFLYAQSSGRITVSTKRSQQAVIPNIGSRPRIRDIPSRISIYWTIVKPGDILLINSTGNLIAPRGYFKIRSGKSSIMRSDAPIGKCKSECITPNGSIPNDKPFQNVNRITYGACPRYVKQSTLKLATGMRNVPERQTRGIFGAIAGFIENGWEGMVDGWYGFRHQNSEGRGQAADLKSTQAAIDQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 139 - protein, 708 aa, Artificial Sequence
  Recombinant influenza HA-ferritin fusion protein
DRICTGITSSNSPHVVKTATQGEVNVTGVIPLTTTPTKSYFANLKGTRTRGKLCPDCLNCTDLDVALGRPMCVGTTPSAKASILHEVRPVTSGCFPIMHDRTKIRQLPNLLRGYEKIRLSTQNVIDAEKAPGGPYRLGTSGSCPNATSKIGFFATMAWAVPKDNYKNATNPLTVEVPYICTEGEDQITVWGFHSDNKTQMKSLYGDSNPQKFTSSANGVTTHYVSQIGDFPDQTEDGGLPQSGRIVVDYMMQKPGKTGTIVYQRGVLLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVDIGNGCFETKHKCNQTCLDRIAAGTFDAGEFSLPTFDSLNITAGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 140 - protein, 709 aa, Artificial Sequence
  Recombinant influenza HA-ferritin fusion protein
DRICTGITSSNSPHVVKTATQGEVNVTGVIPLTTTPTKSHFANLKGTETRGKLCPKCLNCTDLDVALGRPKCTGKIPSARVSILHEVRPVTSGCFPIMHDRTKIRQLPNLLRGYEHIRLSTHNVINAENAPGGPYKIGTSGSCPNITNGNGFFATMAWAVPKNDKNKTATNPLTIEVPYICTEGEDQITVWGFHSDNETQMAKLYGDSKPQKFTSSANGVTTHYVSQIGGFPNQTEDGGLPQSGRIVVDYMVQKSGKTGTITYQRGILLPQKVWCASGRSKVIKGSLPLIGEADCLHEKYGGLNKSKPYYTGEHAKAIGNCPIWVKTPLKLANGTKYRPPAKLLKERGFFGAIAGFLEGGWEGMIAGWHGYTSHGAHGVAVAADLKSTQEAINKITKNLNSLSELEVKNLQRLSGAMDELHNEILELDEKVDDLRADTISSQIELAVLLSNEGIINSEDEHLLALERKLKKMLGPSAVEIGNGCFETKHKCNQTCLDRIAAGTFDAGEFSLPTFDSLNITAGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 141 - protein, 574 aa, Respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 142 - protein, 574 aa, Respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 143 - protein, 574 aa, Respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 144 - protein, 574 aa, Respiratory syncytial virus
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 145 - protein, 574 aa, Respiratory syncytial virus; identical to SEQ ID NO: 144

SEQ ID NO: 146 - protein, 574 aa, Respiratory syncytial virus; identical to SEQ ID NO: 144

SEQ ID NO: 147 - protein, 572 aa, Respiratory syncytial virus
MATTTMRMIISIILISTYVPHITLCQNITEEFYQSTCSAVSRGYLSALRTGWYTSVVTIELSKIQKNVCNGTDSKVKLIKQELERYNNAVAELQSLMQNEPTSSSRAKRGIPESIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSIINDMPITNDQKKLMSVCQIVRQQSYSIMSVLREVIAYVVQLPLYGVIDTPCWKLHTSPLCTTDNKEGSNICLTRTDRGWYCDNAGSVSFFPQAETCKVQSNRVFCDTMNSLTLPTDVNLCNTDIFNSKYDCKIMTSKTDISSSVITSIGAIVSCYGKTKCTASNKNRGIIKTFSNGCDYVSNKGVDTVSVGNTLYYVNKLEGKALYIKGEPIINYYNPLVFPSDEFDASIAQVNAKINQSLAFIRRSDELLHSVDVGKSTTNVVITTIIIVIVVVILMLITVGLLFYCKTRSTPIMLGKDQLSSINNLSFSK

SEQ ID NO: 148 - protein, 574 aa, Respiratory syncytial virus
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 149 - protein, 716 aa, Artificial Sequence
  Recombinant RSV F-ferritin fusion protein
QNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSSNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGGSGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 150 - protein, 720 aa, Artificial Sequence
  Recombinant RSV F-ferritin fusion protein
QNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSSNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGGSGGGGSGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 151 - protein, 706 aa, Artificial Sequence
  Recombinant RSV F-ferritin fusion protein
QNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGGSGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 152 - protein, 710 aa, Artificial Sequence
  Recombinant RSV F-ferritin fusion protein
QNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGGSGGGGSGGSGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 153 - protein, 682 aa, Artificial Sequence
  Recombinant RSV F-ferritin fusion protein
QNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSSNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGSGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 154 - protein, 686 aa, Artificial Sequence
  Recombinant RSV F-ferritin fusion protein
QNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVCKVLHLEGEVNKIKSALLSTNKAVVSLSNGVSVLTFKVLDLKNYIDKQLLPILNKQSCSISNIETVIEFQQKNNRLLEITREFSVNAGVTTPVSTYMLTNSELLSLINDMPITNDQKKLMSSNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGSGGGGSGGSGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 155 - protein, 672 aa, Artificial Sequence
  Recombinant RSV F-ferritin fusion protein
QNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGSGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 156 - protein, 676 aa, Artificial Sequence
  Recombinant RSV F-ferritin fusion protein
QNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVCKVLHLEGEVNKIKNALLSTNKAVVSLSNGVSVLTFKVLDLKNYINNQLLPILNQQSCRISNIETVIEFQQKNSRLLEITREFSVNAGVTTPLSTYMLTNSELLSLINDMPITNDQKKLMSSNVQIVRQQSYSIMCIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGSGGGGSGGSGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 157 - protein, 539 aa, Metapneumovirus
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 158 - protein, 539 aa, Metapneumovirus
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 159 - protein, 539 aa, Metapneumovirus
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 160 - protein, 539 aa, Metapneumovirus
MSWKVVIIFSLLITPQHSLKESYLEESCSTITEGYLSVLRTGWYTNVFTLEVGDVENLTCADGPSLIKTELDLTKSALRELKPVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIDDLKMAVSFSQFNRRFLNVVRQFSDNAGITPAISLDLMTDAELARAVSNMPTAAGQIKLMLENRAMVRRKGFGILIGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFENIENSQALVDQSNRILSSAEKGNTGFIIVIILIAVLGSSMILVSVFIIIKKTRKPTGAPPELSGVTNNGFIPHS

SEQ ID NO: 161 - protein, 539 aa, Metapneumovirus
MSWKVMIIISLLITPQHGLKESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 162 - protein, 539 aa, Metapneumovirus; identical to SEQ ID NO: 157

SEQ ID NO: 163 - protein, 539 aa, Metapneumovirus
MSWKVMIIISLLITPQHGLKESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNKKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 164 - protein, 30 aa, Artificial Sequence
  Signal peptide
MDSKGSSQKGSRLLLLLVVSNLLLPQGVLA

SEQ ID NO: 165 - protein, 24 aa, Artificial Sequence
  Signal peptide
MPMGSLQPLATLYLLGMLVASVLA

SEQ ID NO: 166 - protein, 376 aa, Artificial Sequence
  recombinant influenza HA stem-ferritin fusion protein
DTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 167 - protein, 386 aa, Artificial Sequence
  recombinant influenza HA stem-ferritin fusion protein
DTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 168 - protein, 380 aa, Artificial Sequence
  recombinant influenza HA stem-ferritin fusion protein
DTICIGYHANNSTDTVDTVLEKNVTVTHSVNLGSGLRMVTGLRNIPQRETRGLFGAIAGFIEGGWTGMVDGWYGYHHQNEQGSGYAADQKSTQNAINGITNMVNSVIEKMGSGGSGTDLAELLVLLLNERTLDFHDSNVKNLYEKVKSQLKNNAKEIGNGCFEFYHKCNNECMESVKNGTYDYPKYSEESKLNREKIDGGSGGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 169 - protein, 390 aa, Artificial Sequence
  recombinant influenza HA stem-ferritin fusion protein
QKLPGNDNSTATLCLGHHAVPNGTIVKTITNDQIEVTNATELVFPGCGVLKLATGMRNVPEKQTRGIFGAIAGFIENGWEGMVDGWYGFRHQNSEGIGQAADLKSTQAAINQINGMVNRVIALMAQGGPDCYLAELLVALLNQHVIDLTDSEMRKLFERTKKQLRENAEDMGNGCFKIYHKCDNACIGSIRNGTYDHDVYRDEALNNRFQIKGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 170 - protein, 400 aa, Artificial Sequence
  recombinant influenza HA stem-ferritin fusion protein
QKLPGNDNSTATLCLGHHAVPNGTIVKTITNDQIEVTNATELVFPGCGVLKLATGMRNVPEKQTRGIFGAIAGFIENGWEGMVDGWYGFRHQNSEGIGQAADLKSTQAAINQINGMVNRVIALMAQGGPDCYLAELLVALLNQHVIDLTDSEMRKLFERTKKQLRENAEDMGNGCFKIYHKCDNACIGSIRNGTYDHDVYRDEALNNRFQIKGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 171 - protein, 395 aa, Artificial Sequence
  recombinant influenza HA stem-ferritin fusion protein
QKLPGNDNSTATLCLGHHAVPNGTIVKTITNDQIEVTNATELVFPGCGVLKLATGMRNVPEKQTRGIFGAIAGFIENGWEGMVDGWYGFRHQNSEGIGQAADLKSTQAAINQINGMVNRVIALMAQGGPDCYLAELLVALLNQHVIDLTDSEMRKLFERTKKQLRENAEDMGNGCFKIYHKCDNACIGSIRNGTYDHDVYRDEALNNRFQIKAGGSGGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 172 - protein, 389 aa, Artificial Sequence
  recombinant influenza HA stem-ferritin fusion protein
QKLPGNDNSTATLCLGHHAVPNGTIVKTITNDQIEVTNATELCFNGICLKLATGMRNVPEKQTRGIFGAIAGFIENGWEGMVDGWYGFRHQNSEGIGQAADLKSTQAAINQINGMVNRVIALMAQGGPDCYLAELLVALLNQHVIDLTDSEMRKLFERTKKQLRENAEDMGNGCFKIYHKCDNACIGSIRNGTYDHDVYRDEALNNRFQIKGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 173 - protein, 399 aa, Artificial Sequence
  recombinant influenza HA stem-ferritin fusion protein
QKLPGNDNSTATLCLGHHAVPNGTIVKTITNDQIEVTNATELCFNGICLKLATGMRNVPEKQTRGIFGAIAGFIENGWEGMVDGWYGFRHQNSEGIGQAADLKSTQAAINQINGMVNRVIALMAQGGPDCYLAELLVALLNQHVIDLTDSEMRKLFERTKKQLRENAEDMGNGCFKIYHKCDNACIGSIRNGTYDHDVYRDEALNNRFQIKGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 174 - protein, 394 aa, Artificial Sequence
  recombinant influenza HA stem-ferritin fusion protein
QKLPGNDNSTATLCLGHHAVPNGTIVKTITNDQIEVTNATELCFNGICLKLATGMRNVPEKQTRGIFGAIAGFIENGWEGMVDGWYGFRHQNSEGIGQAADLKSTQAAINQINGMVNRVIALMAQGGPDCYLAELLVALLNQHVIDLTDSEMRKLFERTKKQLRENAEDMGNGCFKIYHKCDNACIGSIRNGTYDHDVYRDEALNNRFQIKAGGSGGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 175 - protein, 390 aa, Artificial Sequence
  recombinant influenza HA stem-ferritin fusion protein
QKLPGNDNSTATLCLGHHAVPNGTIVKTITNDQIEVTNATELVFPGCGVLKLATGMRNVPEKQTRGIFGAIAGFIENGWEGMVDGWYGFRHQNSEGIGQAADLKSTQAAINQINGMVNRVIELMEQGGPDCYLAELLVALLNQHVIDLTDSEMRKLFERTKKQLRENAEDMGNGCFKIYHKCDNACIGSIRNGTYDHDVYRDEALNNRFQIKGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 176 - protein, 400 aa, Artificial Sequence
  recombinant influenza HA stem-ferritin fusion protein
QKLPGNDNSTATLCLGHHAVPNGTIVKTITNDQIEVTNATELVFPGCGVLKLATGMRNVPEKQTRGIFGAIAGFIENGWEGMVDGWYGFRHQNSEGIGQAADLKSTQAAINQINGMVNRVIELMEQGGPDCYLAELLVALLNQHVIDLTDSEMRKLFERTKKQLRENAEDMGNGCFKIYHKCDNACIGSIRNGTYDHDVYRDEALNNRFQIKGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 177 - protein, 380 aa, Artificial Sequence
  recombinant influenza HA stem-ferritin fusion protein
DKICLGHHAVSNGTKVNTLTERGVEVVNATELVFPCGVLKLATGMKNVPEIPKGRGLFGAIAGFIENGWEGLIDGWYGFRHQNAQGEGTAADYKSTQSAIDQITGMVNRVIALMAQGGPDCYLAELLVAMLNQHVIDLADSEMDKLYERVKRQLRENAEEDGTGCFEIFHKCDDDCMASIRNNTYDHSKYREEAMQNRIQIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 178 - protein, 390 aa, Artificial Sequence
  recombinant influenza HA stem-ferritin fusion protein
DKICLGHHAVSNGTKVNTLTERGVEVVNATELVFPCGVLKLATGMKNVPEIPKGRGLFGAIAGFIENGWEGLIDGWYGFRHQNAQGEGTAADYKSTQSAIDQITGMVNRVIALMAQGGPDCYLAELLVAMLNQHVIDLADSEMDKLYERVKRQLRENAEEDGTGCFEIFHKCDDDCMASIRNNTYDHSKYREEAMQNRIQIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 179 - protein, 385 aa, Artificial Sequence
  recombinant influenza HA stem-ferritin fusion protein
DKICLGHHAVSNGTKVNTLTERGVEVVNATELVFPCGVLKLATGMKNVPEIPKGRGLFGAIAGFIENGWEGLIDGWYGFRHQNAQGEGTAADYKSTQSAIDQITGMVNRVIALMAQGGPDCYLAELLVAMLNQHVIDLADSEMDKLYERVKRQLRENAEEDGTGCFEIFHKCDDDCMASIRNNTYDHSKYREEAMQNRIQIDAGGSGGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 180 - protein, 381 aa, Artificial Sequence
  recombinant influenza HA stem-ferritin fusion protein
DKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIALMAQGPPDCYLAELLVAMLNQHVIDLADSEMDKLYERVKRQLRENAEEDGTGCFEIFHKCDDDCMASIRNNTYDHSKYREEAMQNRIQIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 181 - protein, 391 aa, Artificial Sequence
  recombinant influenza HA stem-ferritin fusion protein
DKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIALMAQGPPDCYLAELLVAMLNQHVIDLADSEMDKLYERVKRQLRENAEEDGTGCFEIFHKCDDDCMASIRNNTYDHSKYREEAMQNRIQIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 182 - protein, 381 aa, Artificial Sequence
  recombinant influenza HA stem-ferritin fusion protein
DKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIELMEQGGPDCYLAELLVAMLNQHVIDLADSEMDKLYERVKRQLRENAEEDGTGCFEIFHKCDDDCMASIRNNTYDHSKYREEAMQNRIQIDGGSGGRSCRNSMRQQIQMEVGASLQYLAMGAHFSKDVVNRPGFAQLFFDAASEEREHAMKLIEYLLMRGELTNDVSSLLQVRPPTRSSWKGGVEALEHALSMESDVTKSIRNVIKACEDDSEFNDYHLVDYLTGDFLEEQYKGQRDLAGKASTLKKLMDRHEALGEFIFDKKLLGIDV

SEQ ID NO: 183 - protein, 391 aa, Artificial Sequence
  recombinant influenza HA stem-ferritin fusion protein
DKICLGHHAVSNGTKVNTLTERGVEVVNATELVFPGCGVLKLATGMKNVPEIPKGRGLFGAIAGFIENGWEGLIDGWYGFRHQNAQGEGTAADYKSTQSAIDQITGMVNRVIELMEQGGPDCYLAELLVAMLNQHVIDLADSEMDKLYERVKRQLRENAEEDGTGCFEIFHKCDDDCMASIRNNTYDHSKYREEAMQNRIQIDGGSGGEYGSHGNVATELQAYAKLHLERSYDYLLSAAYFNNYQTNRAGFSKLFKKLSDEAWSKTIDIIKHVTKRGDKMNFDQHSTMKTERKNYTAENHELEALAKALDTQKELAERAFYIHREATRNSQHLHDPEIAQYLEEEFIEDHAEKIRTLAGHTSDLKKFITANNGHDLSLALYVFDEYLQKTV

SEQ ID NO: 184 - protein, 17 aa, Artificial Sequence
  Signal Peptide
MKAKLLVLLCTFTATYA

SEQ ID NO: 185 - protein, 16 aa, Artificial Sequence
  Signal Peptide
MKTIIALSYILCLVFA

SEQ ID NO: 186 - protein, 18 aa, Artificial Sequence
  Signal peptide
MNTQILVFALIAIIPTNA

We claim:

1. A recombinant insect ferritin nanoparticle, comprising:

twelve recombinant insect ferritin heavy chain fusion proteins and twelve recombinant insect ferritin light chain fusion proteins self-assembled into a globular nanoparticle; and eight self-assembled heterologous trimeric antigens extending radially outward from the outer surface of the globular nanoparticle, the eight heterologous trimeric antigens comprising four trimers of a first protein and four trimers of a second protein having a different amino acid sequence from the first protein; wherein the recombinant insect ferritin nanoparticle comprises a shape having a tetrahedral symmetry;

the recombinant insect ferritin heavy chain fusion proteins comprise, in an N- to C-terminal direction, the first protein fused to a recombinant insect ferritin heavy chain, wherein the recombinant insect ferritin heavy chain consists of 172 to 174 amino acids from the C-terminus of an insect ferritin heavy chain; and the recombinant insect ferritin light chain fusion proteins comprise, in an N- to C-terminal direction, the second protein fused to a recombinant insect ferritin light chain, wherein the recombinant insect ferritin light chain consists of 182 to 184 amino acids or 177 amino acids from the C-terminus of an insect ferritin light chain; and wherein:
(A) the recombinant ferritin heavy chains comprise an amino acid sequence at least 90% identical to SEQ ID NO: 2; and the recombinant ferritin light chains comprise an amino acid sequence at least 90% identical to SEQ ID NO: 6; or
(B) the recombinant ferritin heavy chains comprise an amino acid sequence at least 90% identical to SEQ ID NO: 4; and the recombinant ferritin light chains comprise an amino acid sequence at least 90% identical to SEQ ID NO: 8.

2. The recombinant insect ferritin nanoparticle of claim 1, wherein the insect ferritin heavy and light chains are *Trichoplusia ni* ferritin heavy and light chains.

3. The recombinant insect ferritin nanoparticle of claim 1, wherein:
the recombinant ferritin light chains consists of 182 to 184 amino acids from the C-terminus of the insect ferritin light chain.

4. The recombinant insect ferritin nanoparticle of claim 1, wherein:
the recombinant ferritin heavy chains comprise an amino acid sequence at least 90% identical to SEQ ID NO: 2; and the recombinant ferritin light chains comprise an amino acid sequence at least 90% identical to SEQ ID NO: 6.

5. The recombinant insect ferritin nanoparticle of claim 1, wherein:
the recombinant ferritin heavy chains comprise or consist of the amino acid sequence set forth as SEQ ID NO: 2, and the recombinant ferritin light chains comprise or consist of the amino acid sequence set forth as SEQ ID NO: 6.

6. The recombinant insect ferritin nanoparticle of claim 1, wherein the trimeric antigens are viral envelope protein ectodomain trimers and the first protein and the second protein comprise a first viral envelope protein ectodomain and a second viral envelope protein, respectively.

7. The recombinant insect ferritin nanoparticle of claim 6, wherein the first and second viral envelope protein ectodomains are fused to the recombinant ferritin heavy and light chains by a peptide linker.

8. The recombinant insect ferritin nanoparticle of claim 6, wherein the first and second viral envelope protein ectodomains are from two different strains of the same virus.

9. The recombinant insect ferritin nanoparticle of claim 8, wherein the virus is any one of HIV-1, influenza, RSV, MPV, HPIV, Ebola, Marburg, MERS coronavirus, or SARS coronavirus.

10. The recombinant insect ferritin nanoparticle of claim 6, wherein the first and second viral envelope protein ectodomains comprise:
HIV-1 Env ectodomains from two different strains of HIV-1;
influenza HA ectodomains or HA stems from two different strains of influenza;
influenza HA stems from two different strains of influenza;
RSV F ectodomains from two different strains of RSV;
MPV F ectodomains from two different strains of MPV;
Ebola GP ectodomains from two different strains of Ebola virus; or
Coronavirus S protein ectodomains from two different strains of MERS or SARS coronavirus.

11. The recombinant insect ferritin nanoparticle of claim 10, wherein the first and second viral envelope protein ectodomains comprise:
HIV-1 Env ectodomains from two different strains of HIV-1, and wherein the HIV-1 Env ectodomains comprise an HIV-1 gp120 polypeptide and an HIV-1 gp41 ectodomain;
influenza HA ectodomains from two different strains of influenza, and wherein the influenza HA ectodomains comprise an HA1 polypeptide and a HA2 ectodomain;
RSV F ectodomains from two different strains of RSV, and wherein the RSV F ectodomains comprise an RSV F2 polypeptide and a RSV F1 ectodomain; or
MPV F ectodomains from two different strains of MPV, and wherein the MPV F ectodomains comprise an MPV F2 polypeptide MPV F1 ectodomain.

12. The recombinant insect ferritin nanoparticle of claim 10, wherein the first and second viral envelope protein ectodomains comprise HIV-1 Env ectodomains from two different strains of HIV-1, and wherein the HIV-1 Env ectodomains are stabilized in a prefusion mature closed conformation by a non-natural disulfide bond between cysteine substitutions at positions 201 and 433, a non-natural disulfide bond between cysteine substitutions at positions 501 and 605, and a proline substitution at position 559.

13. The recombinant insect ferritin nanoparticle of claim 10, wherein the first and second viral envelope protein ectodomains comprise HIV-1 Env ectodomains from two different strains of HIV-1, and wherein:
the recombinant insect ferritin heavy chain fusion protein comprises the HIV-1 Env ectodomain and insect ferritin heavy chain set forth in one of SEQ ID NOs: 28-52, 55-63, 71, or 73-78; and/or
the recombinant insect ferritin light chain fusion protein comprises the HIV-1 Env ectodomain and insect ferritin light chain set forth in one of SEQ ID NOs: 26-27, 53-54, 64-70, 72, or 79-84.

14. The recombinant insect ferritin nanoparticle of claim 10, wherein the first and second viral envelope protein ectodomains comprise influenza HA ectodomains or recombinant influenza HA stems from two different strains of influenza, and wherein:
the recombinant insect ferritin heavy chain fusion protein comprises the insect ferritin heavy chain and influenza HA ectodomain or recombinant influenza HA stem and set forth in one of SEQ ID NOs: 129-134 or 166, 169, 172, 177, 180, or 182;
the recombinant insect ferritin light chain fusion protein comprises the insect ferritin light chain and influenza HA ectodomain or recombinant influenza HA stem and set forth in one of SEQ ID NOs: 135-140, 168, 170-171, 173-174, 176, 179-179, 181, or 182; and/or
the recombinant insect ferritin heavy chain fusion protein comprises the insect ferritin heavy chain and recombinant influenza HA stem and set forth in one of SEQ ID NOs: 166, 169, 172, 177, 180, or 182; and/or the recombinant insect ferritin light chain fusion protein comprises the insect ferritin light chain and recombinant influenza HA stem and set forth in one of SEQ ID NOs: 168, 170-171, 173-174, 176, 179-179, 181, or 182.

15. The recombinant insect ferritin nanoparticle of claim 10, wherein the first and second viral envelope protein ectodomains comprise RSV F ectodomains from two different strains of RSV, and wherein the RSV F ectodomains are stabilized in a prefusion conformation by a non-natural disulfide bond between cysteine substitutions at positions 155 and 290, and S190F and V207L cavity filling substitutions.

16. The recombinant insect ferritin nanoparticle of claim 10, wherein the first and second viral envelope protein ectodomains comprise RSV F ectodomains from two different strains of RSV, and wherein:

the recombinant insect ferritin heavy chain fusion protein comprises the RSV F ectodomain and insect ferritin heavy chain as set forth in one of SEQ ID NOs: 151-152, or 155-156; and/or the recombinant insect ferritin light chain fusion protein comprises the RSV F ectodomain and insect ferritin light chain as set forth in one of SEQ ID NOs: 149-150 or 153-154.

17. The recombinant insect ferritin nanoparticle of claim 10, wherein the first and second viral envelope protein ectodomains comprise MPV F ectodomains from two different strains of MPV, and wherein the MPV F ectodomains are stabilized in a prefusion conformation by a non-natural disulfide bond between cysteine substitutions at positions 113 and 339, and T160F and I177L cavity filling substitutions.

18. The recombinant insect ferritin nanoparticle of claim 1, wherein the ectodomain is a single chain ectodomain.

19. The recombinant insect ferritin nanoparticle of claim 1, wherein administration of an effective amount of the recombinant ferritin nanoparticle to a subject induces an immune response to the trimeric antigens in the subject.

20. An isolated nucleic acid molecule encoding:

the recombinant insect ferritin light chain fusion protein and/or the recombinant insect ferritin heavy chain fusion protein of claim 1.

21. The nucleic acid molecule of claim 20, operably linked to a promoter.

22. A expression vector comprising the nucleic acid molecule of claim 21.

23. An isolated host cell comprising the expression vector of claim 22.

24. A method of producing a recombinant insect ferritin nanoparticle, comprising:

transfecting a permissive cell culture with the vector of claim 22;

incubating the cell culture for a sufficient period of time to allow for protein expression from the vector; and purifying the insect ferritin nanoparticle.

25. An immunogenic composition comprising an effective amount of the recombinant insect ferritin nanoparticle of claim 1, and a pharmaceutically acceptable carrier.

26. A method of eliciting an immune response to a trimeric antigen in a subject, comprising administering to the subject an effective amount of the recombinant insect ferritin nanoparticle of claim 1 to generate the immune response.

27. A method for treating or inhibiting a viral infection in a subject, comprising administering to the subject a therapeutically effective amount of the recombinant insect ferritin nanoparticle of claim 6 to induce an immune response that treats or inhibits the viral infection in the subject.

28. The method of claim 26, comprising administering 10-300 μg of the recombinant insect ferritin nanoparticle to the subject to induce the immune response.

29. The method of claim 26, wherein the recombinant insect ferritin nanoparticle comprises trimeric antigens comprising:

HIV-1 Env ectodomains from two different strains of HIV-1, wherein the immune response inhibits or treats HIV-1 infection;

influenza HA ectodomains or recombinant influenza HA stems from two different strains of influenza, wherein the immune response inhibits or treats influenza infection;

RSV F ectodomains from two different strains of RSV, wherein the immune response inhibits or treats RSV infection; or MPV F ectodomains from two different strains of MPV, wherein the immune response inhibits or treats MPV infection.

30. The method of claim 26, comprising a prime-boost administration of the immunogenic composition.

31. The recombinant insect ferritin nanoparticle of claim 10, wherein the first and second viral envelope protein ectodomains comprise the influenza HA stems from two different strains of influenza.

32. A recombinant insect ferritin nanoparticle, comprising: twelve recombinant insect ferritin heavy chain fusion proteins and twelve recombinant insect ferritin light chain fusion proteins self-assembled into a globular nanoparticle; and eight self-assembled heterologous trimeric antigens extending radially outward from the outer surface of the globular nanoparticle, the eight heterologous trimeric antigens comprising four trimers of a first influenza HA stem and four trimers of a second influenza HA stem; wherein:

the recombinant insect ferritin nanoparticle comprises a shape having a tetrahedral symmetry;

the recombinant insect ferritin heavy chain fusion proteins comprise an amino acid sequence set forth as SEQ ID NO: 175 and the recombinant insect ferritin light chain fusion protein comprise an amino acid sequence set forth as SEQ ID NO: 167.

33. The recombinant insect ferritin nanoparticle of claim 1, wherein the recombinant ferritin heavy chains comprise an amino acid sequence at least 90% identical to SEQ ID NO: 4; and the recombinant ferritin light chains comprise an amino acid sequence at least 90% identical to SEQ ID NO: 8.

34. The recombinant insect ferritin nanoparticle of claim 1, wherein the recombinant ferritin heavy chains comprise or consist of the amino acid sequence set forth as SEQ ID NO: 4, and the recombinant ferritin light chains comprise or consist of the amino acid sequence set forth as SEQ ID NO: 8.

* * * * *